United States Patent 10,301,642 (GENES AND USES FOR PLANT ENHANCEMENT) - sequence listing, part 2

SEQ ID NO: 5014 - protein, 476 aa, Vitis vinifera
MASSSHRLFHCCFQDWINQQHQDLQELLQVLDTDSPDSDHLRHLIQKSLQHFQDYSATRAELSKLDAPSFFCPSWITSFENSFLWLGGCRPSLAIRLLYSISGSELQAQLPDFLKGCTRGNLADISATQLISINALHGWIVREEDRLSSRMASMQEDTADEPLAIIAKKLRTVGEYSRTVNSAIETHSQALARVLEEADKLRLSTFKGLQEILTPLQGAHFLVASKKLHLSMHEWGKQRAEQKKKMSFESFNEAWFDHLHDLLQQLRLAPKATAPDRDRALLDLVHKVRTHYSQYYRAMSYTARHDVVSLFAAPWSSSLERSLHWVAGWRPTIAFHLIYTHSSILFETHIVDILRGAHNGDLGDLSPAQLQRVSELQCQTVGEENEITAELSECFNSVSGLVGAVFDPVENVERLRNVVERAENLRFRTICSVVEILNPQQAVEFLVAVMELQFWVRGMGLCHDRVRENLRGFRGL

SEQ ID NO: 5015 - protein, 351 aa, Malus x domestica
MTRRCSHCSNNGHNSRTCPTRVGSSSSSPSLGGGVKLFGVRLTDGSIIKKSASMGNLSSAAAHYHSSSPNPDSPSSDQLHDPVHVPDGYLSDDPAHASSSVNRRGDRKKGTPWTEEEHRMFLIGLQKLGKGDWRGIARSYVTTRTPTQVASHAQKYFIRQSNATRRKRRSSLFDMVPDMAPPLPEEQIFLPSSWEGDSEDANSLPSLNLSLSSESKPMETTHEETVIEHDHEPAMGSNGFPPMAPPYVPAYMSYPWPYWAPSAGPFREMVGEPSRQPVLRPIPIVPKEPVNVDALGMSQLSLGETERGLKEPSPLSLKLLGEPSRQSAFHPNAPASEPDLSKGKSSAIQAV

SEQ ID NO: 5016 - protein, 168 aa, Helianthus annuus
SSDDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVSDGPRKLRITGIEYPQPGFRPAERLQETGRRLANYCERFNVQFEYNSIASQNWETVKIEDLKLQRN

SEQ ID NO: 5017 - protein, 323 aa, Malus x domestica
MVSKNPNPPEGLYLDPNESGMPLPGLGPFASATATTSTTSSSAEDLSKKIRKPYTITKSRESWSEPEHDKFLEALQLFDRDWKKIEAFIGSKTVIQIRSHAQKYFLKVQKNGTSEHLPPPRPKRKAAHPYPQKASKNALALPPVSWSCQSSSALLESGFNQRPDSSSMLMSPIPGPVAPSWPNGSVQTANPSHESKVVSGPTVLNNSCSTTESTPKAQPVGGTTDQVNHSHALRVLPDFTQVYGFIGSVFDPNVTGHLQNLKKMDPIDVETVLLLMRNLSMNLTNPEFEDHRQLLSSYKMDANTGNLSDATKTLCDDQHEKVP

SEQ ID NO: 5018 - protein, 110 aa, Triticum aestivum
MQNRVQSHPAGASSSASSGGDGSGSGFCLSDIMEIDAGSGGDHKAPGSPRSKHSATEQRRRCKINERFQILRDLVPQSDQKRDKATFLLEVIEYVKFLQEKVQKHEACAG

SEQ ID NO: 5019 - protein, 370 aa, Zea mays
  misc_feature (66)..(66): Xaa can be any naturally occurring amino acid
  misc_feature (73)..(73): Xaa can be any naturally occurring amino acid
  misc_feature (144)..(144): Xaa can be any naturally occurring amino acid
  misc_feature (163)..(163): Xaa can be any naturally occurring amino acid
MGSSGADTSSKPNKASAPQEQQQPATSGAATPAVYPDWSSFQAYPPIPPHGFFPSPVASSPQGHPXYMWGAQXPMIPPYGAPPYVMYPPGVYAHPSMASGAHPFTPYAITSPNGNADATGTTAVACDTDGKPSEGKDKSPTKKXKGTLGSLNMLTGKNPSEHXGESGSDSSSEGSEGNSHNDSYKHSGQEQDGDVRSSQNGASRSPSEGKFNQAMAIMPMPSSGPVTGPTTNLNIGMDYWANTASSAPVIHGKVTPTTVPGAVVPAEQWIQDERELKRQKRKQSNRESARRSRLRKQAECEELAQRADVLKQENASLRDEVNRIRKEYEELVSKNNSLKEKLEGKQHKTDEAGLNNKLQHSGNDIQKKGN

SEQ ID NO: 5020 - protein, 444 aa, Coprinopsis cinerea okayama7#130
MALSFLSSVASVASGLQKASNSSQPPPPPPPQNPLAAPLQNVSNLPGTSTTSSSASAAASTNGTTAASGSASLAGISVVALCISCQVKPKYFDGSKTHPFCSKTCAASKPKSSSAPKTGSGQASANTCVFCKVRPKYTDNNRTHDYCSKACANRANPQRKQSGLAASHGGNQNTCQAPGCTIPAHPTGDYCSVSHKTLAENLCLLCLKQTKMANSHFCSQTCIDDAEKKGPAILEVPNGHVTFKSVADQFKASWRHVGSTCPTVRRIYKIILPPTTLANYEKYRDAVEAKGQFVAQGRSKGNENRRWHGTRRTCNLGDKGHTQFCASTTCSLCSIIKNSYDISLWGKKTGWGRFGKGIYTSSTSSKSNDYSHNDCKSSLKAILLNKVVVGKGCKMLQDSTSLTAPPTGFDSVLAEKGGSLNYDELVVYTNDAIRPSYLVMYDEP

SEQ ID NO: 5021 - protein, 259 aa, Coprinopsis cinerea okayama7#130
MSGIIDEFSFKHPQNQSCGPSKRLVPLAKADSKYTEISRTFKKGWKHPKKKRPHIYSIFRITIPDHILRPFHHYRARVAAAPGLAGRVKNPANEQLLFHGTTRCCLLGEDSRSTRLCSLPECNLCCIIRMSFNVKKCGSKHRFKRFGRGIYTTTCSSKADDYTANIEQLSNLRVMLVNRVVVGKPHRRQKNATSLTEPPCGHHSVIGEPGIDLNYEETVVYDNDAIRPAYLIVYGDPPPETESKLQTIITTLFKTPLAT

SEQ ID NO: 5022 - protein, 236 aa, Oryza sativa
MSRALWSTASLASRKGIKKADAVKGHWTVEEDRKLVKLVEQFGLKKWSLIGGMLPGRVGKQCRERWFNHLRPNIKKDTWSEEEDMVLIQIHKEVGNRWAEIAKCLPGRTENSIKNHWNATKRRQFARRRNRSTSKSGSTVLQNYIKSLAISPQESQMNNERSESNPSDMMITQGTPCCFDGNNCSQSHTSEENIVPSCVAKTFDDFWEMVYEYQCPVIVMLTQFDSLKVLAYINNL

SEQ ID NO: 5023 - protein, 215 aa, Capsicum annuum
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 5024 - protein, 606 aa, Oryza sativa
  misc_feature (351)..(351): Xaa can be any naturally occurring amino acid
MVLQKRLDYGSHGHRAPIKPRVATLAPVKRSTRIRKKQMYALDLLATAAEKLLADQDNLSSGPNINETPEGYVTSMKPVKAEQFDEAFPLRSVAVKKDDCKGCTVGCAGICGFLRQANMCLAENSSTQNLADSVLESLTAKPDVLAKDSFVSSKKSCRLGFGLGTIPEYGSVGVCQPWSTRSAEVKQVHRARPTAIRSQEDSDAAALCALVETMDLDTKPLAEASSGSNSGVHICGPDRGHNSHPSCLAKVQHAADRDDDENSSGCVHPSTSGNNRGYIPHYIGDRRIRRLFASRLRKAARNRICGEMSGKGNKLSLCEKKMPTTRRRVQQTTLKRKRLAQLYSEKSSDEXTVSDAVTTIIERGLRVGILLQGKNIQNDNKTLRQAGICRGKKLDDIGFTLECEAGQDSHPGVIVPEEMDFVGASVVDKSATVKCEEPAENQQLMQDFPGCSLSNPGSVDYPVEWSTQETSASSQAIVPFADPNSLALANVPLSRSKRPDFGQRRIRRPFTVAEVELLVEAVEHLGTGRWRDVKFRAFENVHHRTYVDLKDKWKTLVHTASIAPQQRRGAPVPQELLDRVLAAQAYWSEQQAKLHGDPPVPEICPT

SEQ ID NO: 5025 - protein, 200 aa, Triticum aestivum
TFESPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 5026 - protein, 356 aa, Arabidopsis thaliana
MPTLYKKAGCMAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 5027 - protein, 147 aa, Physcomitrella patens subsp. patens
DSKPKRCKGENDESVKAKAERSCSENSGDSGSPRALKDSNNRNKILSKQDYIHVRARRGQATDSHSLAERVRREKISERMKYLQDLVPGCNKVTGKAVMLDEIINYVQSLQRQVESLSMKLASVNPGPSTARLDYNFETALNKDMLQ

SEQ ID NO: 5028 - protein, 434 aa, Zea mays
MGGHGDHHHHHQEVGVLVDDDGDDEELEHQGRACGGATSGGVVEQGVGDGGSAGHQDAAGMAFEASISSVGSVSAATTMAPPQILCWPPPPQQQQLQQHHNLGGGHHQSPFFPLLQPPPPPPPPPPQPPFFADLYARRALQLAYDHHHSGGGGGPSTSSDPLGLYMGHPHHHQQHAGPGMMMMMPPPFASSSSPFGDFVGRMTAQEILDAKALAASKSHSEAERRRRERINAHLARLRSLLPNTTKTDKASLLAEVIQHVKELKRQTSEITEEACQLPTESDELTVDASSDEDGRLVVRASLCCDDRADLLPDLVRALKALRLRALKAEITTLGGRVKNVLLITADDSSAAAGCHDDGGAAAPDDDDDDRQEEAAPVSVSSQQHTVASIHEALRAVMERTAAASAAEDSGAAAAGLKRQRTTSLSAILENSRSI

SEQ ID NO: 5029 - protein, 237 aa, Brassica napus
MMSADPFMTMKKIKKSSHNEKNQRRFSEEQIKSLEMMFESETRLEPRKKVQLARGLSLQPSRLAIRFQNKRARWKSKQLETEFNILRQNYNDLASQFESLKKENQGLVSELDRLNEAMQKKRVEGRECCGDQTVVALSSTDHESEKEENTNPEPEEVRPDMEVYEKGHHDDYGYNSHIKREYFGGFEEEADHLMNIVEPADSCLTSSVGWRGFKTNTNILDQSSSNYPWWHFWSSTI

SEQ ID NO: 5030 - protein, 156 aa, Arabidopsis thaliana
MAKTRPGVAFSSKIKLGKKDIKILGREILLGNVIVEVGFFTVGDCVLMRPSDAGKAPYVARVEKIEADARNNVKVHCRWYYCPEESHGGRRQLHGAKELFLSDHFDVQSAHTIEGKCIVHTFKNYTRLENVGVEDYYCIFDYKAATGAFTPDRVAV

SEQ ID NO: 5031 - protein, 294 aa, Vitis vinifera
MMSGDQLQLPAGFRFHPTDEELVVHYLVRKCASQSISVPIIAEVDLYKYDPWQLPGMALYGEKEWYFFSPRDRKYPNGSRPNRAAGSGYWKATGADKPIGRPKTVGIKKALVFYAGKAPRGVKTNWIMHEYRLANVDRSAGKKNNLRLDDWVLCRIYNKKGSAEKQHTFDQKSMKYPELEDQKPKIISTVQNKVVPSSLPSLPPMPAPPTTNDYLYFETSDSVPRLHTHTDSSGSEQVMSPEKEVQSEPKWNDFDFSLYMDGFANDPFASQAQFSGDLLTSSWQDMLMFSNKSF

SEQ ID NO: 5032 - protein, 560 aa, Mycobacterium sp. KMS
MRGKSVAAGLAAFGLLSANVLAPPAALAVAPPVIDPGALPPDETPGPPQEMRQTKACVTPVVVGDPNVAQPDPGNTMLNIEQAWQYSTGAGVTVAIIDTGVTPNPRFPRLFPGGDFVQGLPDGGLTDCESHGTIVASIIGAAPANPADRPTPRPAGAGAPPPPPGVPANPAPPAFPPPPTITATATVTAPAPPPEPPPPPAEPPPGGPPPGGPPPAGPPPAQGPGDTGAAQPLVPGPPPAGPDGVVGVAPDVSLISIRQSSTAFTPARPAPGDIEGQRKAGDIATLAKAIRHAADLPGVRVINVSLASCINAAAPVNQDALGAAVRYAAVDKDIVIVAAAGNQGGGDQGQDCGQNPAFNALDPNDPRDWAGVRTIVTPAWFSDYVLTVGAVTPEGLPLPDSINGPWVSVAAPGWRIMGLSNTNGAAVNARPDEPGLGAGFWGTSFSAAYVSGVVALVRAKFPDLTAAQVMRRITETAHNPARGVDNQVGYGVVDPVAALTFDVPLGDPKPVERLSTDLYVPPPPPGPDHRPRNSALLAGAAVLLVAAVAVAVVGMRRRLR

SEQ ID NO: 5033 - protein, 178 aa, Zea mays
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALPASSGTSYIIPSISVPTNQPRNVTVVVENPMTVDDKGKLVSNVVVGVTSGGKK

SEQ ID NO: 5034 - protein, 188 aa, Lupinus micranthus
SGPYPYFPSSSSSYHPFAFFNPENASSNNTFSHDPFSFPFNIPNTHHYHAPNPETVANFADCAASAAMFKNDVSGSNFGFNNFMAKKPPPKKDRHSKIYTSQGLRDRRVRLSIEIARKFFDLQDMLGFDKASNTLEWLFNKSKKAMKELARSKNSSSGVVANSFSSSDSECEVVSMINQDSIDATPEG

SEQ ID NO: 5035 - protein, 192 aa, Arabidopsis lyrata subsp. petraea
DVYNPIKNHNPNPNPSPKHLMSSYSCRRSTQSLKDVIETKKTKPKPKKPKSKPDKREPDPVLSPSTRIRSTGARDRDPFLPTLTELAEGHQSRNVVEIIFQTSWGPKPFSGRVEMIFKVQNGSKTLTRFEEYREAVKARSVGKAREENARSVADGNETMRFYCLGPSYGGGGGAWGILGGKGVGASIYTFAG

SEQ ID NO: 5036 - protein, 269 aa, Brassica napus
MAPLPFLPAQTKSQTRLSSNSKKKNGNKKTSTQPPQTQTLKQTQKLKQKTVSSSSSSSWSQIKNLLSCKQIEGPRVHDPSKITLSSCGSSLCKFSDVIYGNARVIHRSDHSPESSNLGQDGGLLIRKPATRGSSSTVRSNGCGAYTSSSKAMHFRKLSGCYECHMIVDPSRYPISPRIFACPQCGEVFPKLETLEIHQAVRHAVSELGPEDSGRNIVDIIFKSSWLRKDGPLYKIERILKVHNTQRTIQRFEDCRDAVKSHAHASTRKE

SEQ ID NO: 5037 - protein, 281 aa, Glycine max
MQEPSLGMMGEVSGDHHRQLKAEIATHPLYEQLLAAHVACLRVATPIDQLPLIDAQLSQSHHLLRSYVSHNTLSLSPHHRQELDNFLAQYLIVLCTFKEQLQQHVRVHAVEAVMACRDIENALQALTGVSLGEGTGATMSDDEDDLQMDISLDQSSAEGHDMMGFGPLLPTESERSLMERVRQELKIELKQGFKSRIEDVREEILRKRRAGKLPGDTTSVLKNWWQQHAKWPYPTEDDKAKLVEETGLQLKQINNWFINQRKRNWHSNSQSVTSLKSKRKR

SEQ ID NO: 5038 - protein, 159 aa, Phillyrea latifolia
LRTNSLEVSSGCGKGFMLFGVRVMEGSFRKSASLSNLAQYEQPHESNNDVAAGYASDDIVHPSGRSHDRKRGVPWTEEEHRLFLIGLQKVGRGDWRGISRNFVKARTPTQVASHAQKYFLRRNNHSRRRRRSSLFDITTDTVLDSKIGDQRHQENWYAV

SEQ ID NO: 5039 - protein, 324 aa, Arabidopsis thaliana
MTSIPNGLNSYVDDTVNICGFTPIEMSSNLRNHESKMVHSMFNTSDHTNHHGLFSSSRVFNFYQDSHVSSSSFGFNNSHMAYHMRKNMVSTFGMPCITQNSNNPHLSQISITQTITNSYSAIVPTYNLITSQNEYQRAKEPNIFNPPFYPPNFVDKNVGNQCQILNPTPLNTIFPHQASIFPRNVDKFSFSPKQNPHQYVSYRQPLKRHCRPTKKFENTFSDFDSGKDIEYDGRTHSLPYEKYGPYTCPKCNSVFDTSQKFAAHISSMHYKNESIEEKFKRYNARNKKRLRKRNQMIHEESNNIQPEEIVAEESGGDNNIASSK

SEQ ID NO: 5040 - protein, 474 aa, Zea mays
MEKDVGSGSVSAFPRQAKNCLAENSSTRNGADTVLESLTVKSNMLAKIPECGSYGIHHAGSSSSAEPEQVHQAEPKVSRRQADGHPVAYGIFNSVDVDGKPPALVSSDSSSCVPLSSHDKEHQTSSLYRGVVQYTADREDDENSSGCTHPSTIETSGTSFAMEGQNKSCEAENYHVKLRIKSFNIPELFIKVPENATIGSLKRAVMDVVNSIMEGGLRVGVLLQGKDIQDDNKTLCQAGICHDKKLNNIDFTLECEREREPPSGVIIQEQMDFLTTDMVEPLARMKCEEPFPEADVGDDSQQPRAPYRSRSLSDLYSVHCPVQMASQDTTASSQAIVPVSPAPSDVGALAIVPLCKSKGSEVGQRRMRRPFTVGEVEALVGAVEQLGTGRWRAVKTLAFDSIDHRTYVDLKLKDLQKQPVLVDFNAVLDKWKTLVHTASISPQQRRGQPVPQELLDRVLLAQAYWSQQQQQARL

SEQ ID NO: 5041 - protein, 124 aa, Triticum aestivum
MYHHQQLLLQEEGTLEAVLWQPVTAPAPAERGEPGNNGAPGPGGAVVGAARKRPFRTDRHSKIRTAQGVRDRRMRLSVGVAREFFALQDLLGFDKASKTVEWLLTQSKPAIDRLADATQGGAAA

SEQ ID NO: 5042 - protein, 357 aa, Oryza sativa Japonica Group
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQNTKSDLQAMEQKLQGTEQKQQHMMAFLSRVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSPQ

SEQ ID NO: 5043 - protein, 946 aa, Vitis vinifera
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVCIHSLDGCWFLNNEYEIWKMLAGYKIVPQICFIAVSCLMSIGNLVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKQKLAMVVLVGRAIELIEMHKSLLPLLDRFLNGCTFGWFLFSGLWEAPVDDGF

SEQ ID NO: 5044 - protein, 330 aa, Arabidopsis thaliana
  misc_feature (126)..(126): Xaa can be any naturally occurring amino acid
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKXKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFARLRALSSLWLARPRE

SEQ ID NO: 5045 - protein, 278 aa, Vitis vinifera
MDGRFNSNPFVSEQEEQENSPENSGDSPPSPMFNDAKISSSTSSPKRSRRAMQKRVVSVPIKDVEGSRVKGDCAPPSDSWAWRKYGQKPIKGSPYPRGYYRCSSSKGCPARKQVERSRVDPTMLVVTYSCEHNHPWPASRNHHNTTNPPTTAAATPTPTSAPATPPSPKPAIFSSQAEPDPDEKFTDLGEESLITTEDFTWFSDFESPSSTMLESPIFAENNVRDADVAMFFPMREEDESLFADLGELPECSLVFRRGVLEMEEERRRCTVPMCGTTS

SEQ ID NO: 5046 - protein, 176 aa, Glycine max
MATEEVNKPQSLPPYPEMIVKTLEALNEPNGSNKSAISKYIETTYGELPDATVLGSHLNKMKDSGELSFKQNNYMKADPNAPPKRGRGRPPKPKTPLPPGTVVSPPRPRGRPPKDPNAPPKSPKAKATPGSGRPRGRPKKVPRSPAVAAPTAVSSGRPRGRPPKVKPQLTEVSVES

SEQ ID NO: 5047 - protein, 244 aa, Zea mays
MDGAEDDGTEWMMHGAGGKGKGGGALDKNKKRFSDEQTKSLESMFATQAKLEPRQKLQLARELGLQPRQVAIWFQNKRARWKSKQLEREYSALRDDYHALLCSYESLKDEKRALLKQLEKLAEMLHEPPQGKYYGGNADDVRSGGVGGTKEEEESTDACAGAALYSSECAGGGRFIAHFLADDDVGAALFRPPSSPQPTAGLLTSSGPPEHQPFQFHSGYCWPSSSAEQTCSGSQWWEFESLSE

SEQ ID NO: 5048 - protein, 152 aa, Glycine max
ALNEADGSNKSAISKYIETTYGELPDETVLGSHLNKMKESGELAFKQNNYMKADPNAPPKRGRGRPPKPKVPLPPGTVVSPPRPRGRPPKDPNAPPKSPKAKATPATGRPRGRPKKVARSPAVPSPTAVSTGRPRGRPPKVKPQLTEVSVES

SEQ ID NO: 5049 - protein, 359 aa, Brassica oleracea
MTRRCSHCNQNGHNSRTCPNRGVKLFGVRLTEGSIRKSASMGNLSHYSGSGLSGLGGTGSNNPGSPGDGHDHGVGDGYASEDFVPGSSSSRERKKGNPWTEEEHRMFLMGLQKLGKGDWRGISRSYVTTRTPTQVASHAQKYFIRQSNVSRRKRRSSLFDMIPDELTDVMVDSQEQQAEDVPMETQMQSTDSVPAPLILETEECESMKSTNSSAEEPPTVTASSSSFTPEDTIQTQLQVQQPPGSFPVLYPTYFSPFYSFPFPVWPAAYVTEPAKEETHEILRPTAVHSKAAPINVDQLLGMSKLSLGESSQNGVSEQSLSLKLVGGSSSRQSAFHPNPASGGGGSDMNTVIHAVQKSA

SEQ ID NO: 5050 - protein, 306 aa, Zea mays
MSSLLCISRRNNKKDSDGDGEYGGEQIIISTGGAAMRKGPWTDEEDEQLVRFVRLFGERRWDFLAKVSGLRRTGKSCRLRWVNYLHPGLRRGRITADEERRIVELHAQWGSRWSRIARSLPGRTDNEIKNFWRTRTRKKALEERRAAAAATSTAAESASSVMTVSSSSECRRPPVSSSSSSSSLRRDEARRSGDETEEASTPTAAPATKHDEEPQPQPQECYDFPMDQLWNEIAAADAAAMSYLVVDACWGGAAVGGHCYYYGAAAASAASPPPPASPPWEYCGSDFSLWRIDDQEYYKKMLDSSS

SEQ ID NO: 5051 - protein, 312 aa, Vitis vinifera
MRNASSASAPPSSSSKTPCCIKVGLKRGPWTPEEDEVLANYIKKEGEGRWRTLPKRAGLLRCGKSCRLRWMNYLRPSVKRGQIAPDEEDLILRLHRLLGNRWALIAGRIPGRTDNEIKNYWNTHLSKKLISQGIDPRTHKPLNPNSSVDVKASSSKAKAVMNPNPNPNPNPSPSEKAAANKEAGNFKSDNQYQIGAAGNDGSANIQNSDGSGTGLRSSNNEEDDDLNCGTDDVFSSFLNSLINEDLFPGQHHLQQQHHGGLIAPGSDALISTSSVQSFGFGTSWEAAAMTSTSAFSQIDHSKRFNDQPDKRF

SEQ ID NO: 5052 - protein, 421 aa, Oryza sativa Japonica Group
MDGNARSAANQTKQIVTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 5053 - protein, 192 aa, Lupinus bracteolaris
STYTSSGPYPYFPSSSSSYHPFAFFNPENASSNNTFSHDLLSFPYNTPTTHHYHAPIPETLSNFADCAASAAMLKNDVSGSNFGFSNFLAKKPASKKDRHSKIHTSQGLRDRRVRLSIEIARKFFDLQDMLGFDKASNTLEWLFNKSKKAMKELARSKNSSSGVAANSFSSSDSECEVVSMINPDSIDATPE

SEQ ID NO: 5054 - protein, 253 aa, Oryza sativa Japonica Group
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKENPCSFLQLVEKQKVQKQQVQWDQTQPQTSSSSSSFMMREALPTTNISNYPAAAGERIEDVAAGQPQHVRIGLPPWMLSHING

SEQ ID NO: 5055 - protein, 201 aa, Arabidopsis lyrata subsp. petraea
SHQSTWHQGFTRKARTPRGGKKSHTMVFHDLVPEMSTEDQAESYEVEEQLIFEVPVMNPMVKEQCFHQSVETKVEFPMMPLSFKCSDEEDEDNAESCLNGLFPTDMELAQFTADVETLLGGGMEREFHSIEELGLGEVLKIEKEEVEEEEGVVTREVYDLDEAEETSPFEISFDYEYAHKTTYEEEEEDEKEDVMKNRMDV

SEQ ID NO: 5056 - protein, 305 aa, Nicotiana tabacum
MMTMVGHCGYLDGIPTGPVVDEDFDDILNFLDFPLESLEEDGQGVEWDASESKFLGPIPMDALMAFPPVPQGNIGNGRVKAEPNSNHPIKVTEGQGSGIFQTQSPVSVLESSNSCSGGKSISIKHDIAIPVRPRSKRPRSSALNPWILMPPISSTRFASKKTCDARKGKEKKRKMSLLSVPQIADVTKKKTTSGQQFSFKKCTHCQVTKTPQWREGPLGPKTLCNACGVRYRSGRLFPEYRPAASPTFVPTLHSNSHRKVVEMRKKAIYGETSALEEPHNVIVEGPPMSPAPEFVPMSSYLFDVY

SEQ ID NO: 5057 - protein, 651 aa, Oryza sativa Indica Group
MENGLESSVSFEAKLENRLESSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINVTLSIVGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSEKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 5058 - protein, 178 aa, Zea mays
PPPQKDDVTDAAALSQQLPIGPAIDDSCLQQAFFATPQSRNEAPAPPLQPPAKLRIGGATRSKRKKKSKKEVKRVPVVGASPDPWAWRKYGQKPIKGSPYPRGYYRCSTDKDCRARKQVERCRTDPSTVIVSYTGEHSHPVPLHRNALAGTTRNKPQPASSICNSPGRAASPIGDDDL

SEQ ID NO: 5059 - protein, 207 aa, Pyrococcus furiosus DSM 3638
MEDLRPERIQEIGRTDCPVCKGKNTLKLIQFIHKIPYLGEVMLSTAICDNCGYRDADVMILEAREPKLYEVKVEEEKDLFTRVVRSKSGTIELPELGITIEPGPRAEGFISNIEGVLERVKEVLLMARDFKEQENDEASVKKIDELLRYIEEVKEGKKPLTVRIMDPFGNSALIGEKVKSRRLTKEEIKSLSTGPYYVIDLDELPQQ

SEQ ID NO: 5060 - protein, 334 aa, Arabidopsis thaliana
MSSLPWKKPKSSRILRFISEFQQSPFVETGFPTSLIDLFFKNRDRLKKSPSKRFQRIERQIRTAPNASSLSNQDTIFEKPSRIKTVRSKVEKVNCVKGKSAALKKNAIKNSVFGGSGEVVLMAFKVLIVALLALSTKKKLTLGITLSAFALLLTELVAARVFTRSNNTDKDKNAIAREKIETFDETRVPKAIPCPEETEHVVSETEVSKLKGLTIRDLLSKDEKSTSKSWRLKSKIVKKLRSYNKKDKKTMKIKEESLIEVSSLVLEDKPKKIESERDEEETLNPPVVGSNLNGIVLIVIVLTGLLCGKVLAIVLTLSCLVLRLGAVKKVNLCI

SEQ ID NO: 5061 - protein, 206 aa, Picea sitchensis
MDVAGGVSNNINMKMLNMLELIRHHLLDVEDEIDIIDLQRGNQVLASGSRLTSDGNKFAEAQDYSSSSSVCPVIRREDAFNVKPQAHDEDNGENKQISRASHYRGVRRRPWGKFAAEIRDPAKKGARVWLGTFNTAEEAAHAYDRAAFRIRGARALVNFPLAFASNSENGSAVSHMGQKRKRGNGGGGTLDLGACGWIMEKLICLS

SEQ ID NO: 5062 - protein, 84 aa, Chlamydomonas reinhardtii
QARKPYIITKQRERWTDEEHARFLEALKLYGRAWRKIEEHVSTKTAVQIRSHAQKFINKLERNKDSGIPPPRPKRKPSRPYPRK

SEQ ID NO: 5063 - protein, 475 aa, Vitis vinifera
  misc_feature (37)..(37): Xaa can be any naturally occurring amino acid
  misc_feature (51)..(51): Xaa can be any naturally occurring amino acid
MHDGNEFKLKEEHLDASSTANALTGGEWLRGVEGETXMKATIEHANKVYKXVRGIIGNVETKQQMDLTQAKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 5064 - protein, 254 aa, Brassica rapa subsp. pekinensis
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELLERNQRHYLGEDLESISIKELQNLEQQLDTSLKHIRSRKNQLMHESLNHLQRKEKEILEENSMLTKQIKERESILRTHQNQSEQQNRSHHVAPQPQPQLNPYMISHQASPFLSMGGMYQGEDPTAVRRNRLDLTLEPIYNCNLGYFAA

SEQ ID NO: 5065 - protein, 323 aa, Medicago truncatula
MEGQQNGSKSNYTFPPGFRFHPSDEELIVHYLQNKIKSRPLPASIIAEIDLYKYNPWELPKKSLFGEEEWYFFSPRDRKYPNGLRPNRTAASGYWKATGTDKPIISSCESKHIGVKKALVFYSGRPPKGVKTDWIMNEYRLVDTTAKSFKLKGSMRLDDWVLCRVRNKGYSLKNLSENQENPSEPTIPLNLPRGEERPTNVNLRSDIITDYQFKDYQIIASILVGGVIPPTENMSSLSVNGSKFNNLNSVSEEGFNKANSQTTNYSLECYFNPLKRKSNEDDDQFENLISFNSKFNSENKLCESPSIDFQKLNKFTFTERYQQ

SEQ ID NO: 5066 - protein, 647 aa, Zea mays
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLHPGARPPASTGGIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYAFLDRNARNSHQYTCKYNDPITQSAENKPLPAPPQPQAFQPAFSQANQAVNNLDFSLPMDGQRSIAELMNMYDTNFMTSKTMSSSDSVTIMERPNAMPQRIQMDEGFFGQGNGVFDDVNSMMQNQQQNQAPPVVQQQQQQFFIRDDTPFMSQMGDITSTAEFRFGSGFNMSSTAAAADYPGAAQKNDGTNWFY

SEQ ID NO: 5067 - protein, 293 aa, Triticum aestivum
MSRSRTVRIYWDDPDVTDSSSEDDEGCAARRVGRMVRELPPAPAPLVQAAAAAPSPEQCSAGDDDLPRRVGGCTRARKRLAKGGGSAAQSTKFRGVRRRPWGKYAAEIRDPWRGVRVWLGTFDTAEEAARVYDNAAIQLRGATATTNFSTSSTNSEGAQEDLTAAGYESGAESSQAVSSPTSVLRKVPSMSSLAEDRGDSEACQGDAAAGSSLSVPEELGEFVPFEDAPVYSSSSFWDFEPQSGFLYAEPSSAEEASWDASAGGEPWAAPVQENDYFQDLRDLFPLNQLPAIF

SEQ ID NO: 5068 - protein, 627 aa, Emericella nidulans
MDGGQTTTSAAPSGNSSDFVRKLYKMLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRVAPQPAAAATNPALVYPKMNGEMEPVVYPVGATNGIDPMYGEHVNNVPYTVPPKQDMDDRRQFPENRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQLYFQHGMDDVLPKPFTRKSLLEMLEKHLVHLKTVPQGMEGHQATTPVTIAGQSSAAQSVTIKEDTSSPSQSPAAAMTAWQSPNQFQPMAAVPANLQQVQGQYVPANPATTAYAMDQNGMQYPAPPTVAMGAAGPGQVRPQPRRHISELGNGNDNPNLAKRQRMYAPQSQPMVGSMPATRTH

SEQ ID NO: 5069 - protein, 243 aa, Betula pendula
MGRGRVQLKRIENKINRQVTFSKRRGGLLKKAHEISVLCDAEVAVIVFSHKGKLFEYATDSSMEKILERYERYSYAEAQLVAADSEGQGSWTMEFARLKGKVELLQRNHRHYLGDDLESLSHKELQNLEQQLDTALKHVRTRKNQLMYESISQLQKKEKAIQEQNTILAKKIKEKEKTVAQHVDWEQQNQGAPNGSSSFLLPQPLPCLNIGGNYQEEAPEVRRNELELTLEPIYSCHLGCFAT

SEQ ID NO: 5070 - protein, 189 aa, Zea mays
  misc_feature (55)..(55): Xaa can be any naturally occurring amino acid
  misc_feature (155)..(155): Xaa can be any naturally occurring amino acid
  misc_feature (158)..(158): Xaa can be any naturally occurring amino acid
MNSKEMCQEPCDELSEISSQEASNSSGLVSLDLTLTVAAAAAESSTTDNRTSGRXPADAAAVAREPSRVFTCNYCQRKFFSSQALGGHQNAHRRERTLARRTLRIDAAGPYGSYADVASLPLYGSGLYPIGIQAHASTAAHPEQQRHEDAAELKXARXLLSPMPFLVADEAEMSFGWPGSFRPATAVAP

SEQ ID NO: 5071 - protein, 236 aa, Triticum aestivum
AAALELVDPPGCRNSARGRSGGAAAAGEIGLDPELDEFMEAYCRLLSRYKEELSRPLDEAASFLTTIRSQLTNLCGGGATATSPHSDEMVGSSEDEPCSGDADGSDAGMQEHSSRLADHELKEMLLKKYSGCLSRLRSEFLKKRKKGKLPKDARLALMDWWNTHYRWPYPTEEDKVRLAAMTGLDPKQINNWFINQRKRHWKPSEDMRFALMEGVTGGGGSSSGTTLYFDTGTIGP

SEQ ID NO: 5072 - protein, 243 aa, Glycine max; identical to SEQ ID NO: 219

SEQ ID NO: 5073 - protein, 272 aa, Arabidopsis thaliana
MDSSSGKPRSSDSSCIISASTSLQFSDSPKLSLENYNIDTVAAQEEDDHDQKEGVEGIKLDLMLAGYDSSQPQLNQELNLLDCLETGVVTPSFNGSTSTEQKLFSCNYCQRTFYSSQALGGHQNAHKRERTLAKRGQRMASAAAFGHPYGFAPVPFHGQYSNRTLGIQAHSMSHKPSSYNVYGGEYGQINWSRIPLVQQPAIAKLTSTENHYNHHQMMIAPPLTSTCENIGRFDVGRIPVEFPTSELWQRGEELLKPAEEEKQKNLDLSLKL

SEQ ID NO: 5074 - protein, 597 aa, Physcomitrella patens subsp. patens
MGCNNSKIDNEEGLSRCKQRKHLMKQIVASRHNFAASHAMFVVSLKGVGSAFRQFAEGEVKDEVRYLMHSEVSTPRTETLSFGPPPTLPPAPMSPGFSPSPPHSPVSPHVRHSTSPPISHAATRSNPTPPPPVTRSSWQDLFMDPFRPSPPTFNYMEERKNQDVDSRLSPAAEPPAKVANAGKGQKTPISGKTPGKPPKPEQSISKTNKELAVVKAEKGGRDLLDVLKEVDECFLRAADSGENVSRILETKKAHYHSSFSDSLRASFRTSGNMNSMSVLTDESPSIMSMRRNISNMSSARYTEECGLGNSHAATLDRLLAWEKKLYLEVKEAEALRVELDRKYHLFRNQDAKNEDHTVIDKTRYTIKGLQTRMVVAIQAVDSASQQVQKLRDEELYPQLVELLNGLGTMWKNMSQAHQAQLRAVETMRRLDNSAACEPTTSSHRQSTMFLEQALNKYYSYYYMMAAPIFRLCQRWEELLSQLPHQVVLEGIGSFAAVVREMLRLQWEELRIKKRVENYQRELERREYALLTVSSKDPGFPERSEVGDRRLKYEATRRKLEAELEAERKAYTDTRAFTLNSLQAGLPQLFLGVLAFTN

SEQ ID NO: 5075 - protein, 57 aa, Physcomitrella patens subsp. patens
YRGVRMRAWGKWVSEIREPNKRSRIWLGSFPTAEMAARAYDAAVLCLRGPKATLNFP

SEQ ID NO: 5076 - protein, 369 aa, Arabidopsis thaliana
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 5077 - protein, 628 aa, Vitis vinifera
MDTPEKYQIATPISKYEDSPVFNYINSLSPIKPVKSIPTDQTFSSLSFASPSSVFTSPHINPQRESRFLRRQQFTDPSKPEFSRRDNDENTSEGVLDAVHQLDYLDPGSSDTGITIDPSNKDPKSDAGLPQSLKYDCTSPEDNRIPHNDIETETMPEVAIRPASHVHFVQGVSKERRQSFEIETELRGICQIGESKEAAGCDWGKLISDDTDQLIFDSSISKEHSEVQDHKTVDPGTYSFIATVLQLPHDEIDDLQKSQSMGSVDSYEQCETEETVTKSRDVGEIKETDQTPAVPSSTLLDKLVVSDSRAELGSQQQLSIRRRCLLYEMTGAHKKKLIYNSDSGSSASSQSDGKVSSDEKQFMPFKPGNIHPSSMLAGIGLHLNALATTAEDGNKVVKHEPLASERKPISMSRSIPSLNSMSLGQTPLNKSLTPDLLERDLVRFDSEVQATEDASQTSEFGVSEEFNHGSPKRKRRRSEQAAENEACKRCNCKKSKCLKLYCECFAAGLYCVEPCSCQDCFNKPVHEDTVLQTRKQIESRNPLAFAPKVIRSSDYVPEFGDESNKTPASARHKRGCNCKKSSCLKKYCECFQGGVGCSISCRCEGCKNTFGRKDGECLSAALKMQLRS

SEQ ID NO: 5078 - protein, 245 aa, Phalaenopsis amabilis
MGRGRVQLKRIENKINQQVTFSKRRSGLLKKAHEISVLCDADVALIIFSNKGKLCEYSTDSSMEKILERYEHYSYTERALYSNEDNPQADWRLEYNKMKAKVESLQKSQRHLMGEQLDYLSIKELQHLEQQLESSLKHIRSRKTQLMVDSISELQKKEKLLLEQNKTLQDMAKAKAKALVQNAAWEQQNKSQYSSEPPHAVISDSVPTPTSRTFQTRANGEESPQPQLRLGNSLLPPWMLSHVNG

SEQ ID NO: 5079 - protein, 250 aa, Phalaenopsis amabilis
MGRGKVQLKRIENKINRQVTFSKRRSGLLKKAHEISVPCDAEVALVIFSAKGKLYGYSTDSCMDRILDRYERYCYAEKALQITEPESQGDICNEYGKLKNKIEALQKSRSHLMGEQLDSLSIKELQHLEQQLETALNHIRTQRIQLLLNCITEFQRKEKSLLEHNSLLEAKLCSFQLDPQITETATQNPNRKQQKQDQVNSSPSPFLPPNHLPTLNLGTYPASDGEEAEDPTLLQMNSISLPPWMLRSST

SEQ ID NO: 5080 - protein, 925 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKLLLVPVDLKLRSSLPSSLHSLSSFDSPPIFSDAGENNLLHQSPTARSRRPMVFPLFLSQPNSSSRSISIPHRKLHKSDSKSLPHSRMRLYDDLLINGYYTTRLWIGTPPQMFALIVDSGSTVTYVPCSDCEQCGKHQDPKFQPEMSSTYQPVKCNMDCNCDDDREQCVYEREYAEHSSSKGVLGEDLISFGNESQLTPQRAVFGCETVETGDLYSQRADGIIGLGQGDLSLVDQLVDKGMDVGGGSMILGGFDYPSDMVFTDSDPDRSPYYNIDLTGIRVAGKQLSLHSRVFDGEHGAVLDSGTTYAYLPDAAFAAFEEAVMREVSTLKQIDGPDPNFKDTCFQVAASNYVSELSKIFPSVEMVFKSGQSWLLSPENYMFRHSKVHGAYCLGVFPNGKDHTTLLGGIVVRNTLVVYDRENSKVGFWRTNCSELSDRLHIDGAPPPATLPSNDSNPSHNSSSNLSGVTQVGQINLDIQLTVNSSYLKPRIEDLSKIFSKELDVKSSQVSLSNLTSKGNESLVRMVVLPPEPSTWFSNVTATNIVSRFTNHQIKLPEIFGNYQLVNYKLEPPRKRTNNNIVVIAIGIIAVIVGLSAYGAWLIWKRKQTSIPYKPVDEAIVAEQELQPI

SEQ ID NO: 5081 - protein, 366 aa, Chrysanthemum vestitum
MTNSDQPSTTPSSSMDSPRKRKSRSRRDGPKGVAETLAKWKEYNNKIDSLDEKAKPARKVPAKGSKKGCMKGKGGPENSRCKFRGVRQRTWGKWVAEIREPNRGSRLWLGTFGSAVEAALAYDEAARVMYGSCARLNLPNCRSMNEYSQMVVPNGSASSCDSTTTCSHSLEDSKASSSRQMIKQDEGDSKREDTIVKHEVKEEPVEEFKSIRIKDEPVETNEDISLPHVNEMFDMEELLEMMGQRKSQNTGNRMGQNGFDEPSGVSQPWIKIEPQSEYQQDTYGTGGGFGFDFSMPKQPAMDQKLGDMGWFDQEPMNPYTRPKWEDKCDVGAVADYGFDFLMPGRPEDGNFTLQELGFDLGADFGL

SEQ ID NO: 5082 - protein, 151 aa, Glycine max
MYPFKKRKFFNQTSSSASDRGSQCQGMFDSSDTIRVNGTNHAIEESSSIVGQQAHFGSRGCNVKLSIKSFKVPELFIDIPETATIGSLKRTVMEAVTAILGDELHVGILLQGKKVRDDSKTLIQTGISQDDKRHRLGFMLEPRHTQSPSSY

SEQ ID NO: 5083 - protein, 242 aa, Triticum aestivum
MKSSSVQEACEDQVSEISSQAASNNNEASNTSSGPKLALDLSLTVTAAAAAATTTAESSTTDSNNGGGQAAREPTRVFTCNYCQRKFFSSQALGGHQNAHRRERTLARRAVHRLEAYPYGYADVASLPLYGSPGLYPIGIQAHASALQGAAAAAQAERQQHQQQDAAVLAAPARARALLGPMPFLVGGDEEVSFGWPGSFRPPPPGAGVLPLLHSGPNFGSSSGSGSVVVQADEEPDLTLRL

SEQ ID NO: 5084 - protein, 338 aa, Arachis hypogaea
MAVYDQSGDRNRTQIDTSRKRKSRSRGDGTTVAERLKRWKEYNETVEEVSTKKRKVPAKGSKKGCVKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVGTCQQQQQDSLSVADYGWPNDVDQSHLDSSDMFDVDELLRDLNGDDVFAGLNQDRYPWNSVANGSYRPESQQSGFDPLQSLNYGIPPFQLEGKDGNGFFDDLSYLDLENVDA

SEQ ID NO: 5085 - protein, 842 aa, Pinus sylvestris
MAACIAMNTRFRGVDTSGEEVFVVGETDSNNSMIIPASEGENRRKRTGMELNGPLFRRINPSESSDYGQIKWNNLSSGLRESQTPVPLASAAGWQYPSSATVDSVSHRISAPSRTPGLGLANSVLCGESNGQPFNGAYSSMPFFQNSNMERQVSNSCSQWNKWGSVVQPEVGLGCDGTGQQLSSLNAVQTMDEAAVWVDGMIKDLMMQSSPNVSMAQIIQSLQEIAPLYNPHIASVLEYRLRSLGQSELGLAGNTQIGRDQNVGMNVSSDGRGLKRSMDQSDHHRRDMNSQQQIMVDWKSIGANPDSARSARASQLDDDENRLLDNIHGRGLDVDDQRLRRGNDDLRLRIQSTESHDIQREHQPDSALKLYLDSSGYDQTPWASSKDQFSETAFMANQSMWVQPRQPDNNSQPPVLSLQHQANEDDPLRVAPSNDSYITMNRRINTNSNQDPSGNQTPQQQGPSDITASDEEGLHLLALLLQCAEAVSADNFEEANTILPQITELSTPYGNSVQRVAAYFAEAMSARLVSSCIGMYSPLPPIHMSQSQKIVNAFQVFNGISPFVKFSHFTANQAIQEAFEREQRVHIIDLDIMQGLQWPGLFHILASRPGGPPHVRITGLGTSLEALEATGKRLSDFAHTLNLPFEFHPVADKVGKLDPERLKVNRGDALAVHWLHHSLYDVTGSDTNTLRLLQRLSPKVITVVEQDLSHGGSFLSRFVEAIHYYSALFDSLGASYPEDSHDRHLVEQQLLSREIKNILAVGGPARTGEIKFDNWRDQLKQTGFKPISLAGNAATQATLLLGMFPCQGYTLMEENGTLKLGWKGLCLLTASAWRPAHHGLIY

SEQ ID NO: 5086 - protein, 351 aa, Arabidopsis thaliana
MTPLLVAVSRKKIDLMSEFFLGCPESIVDANVNGENALHIAVNNYDQREGLSVLKVLMGWILRLCQKDAEWIETRVINRRDKDGNTPLHLAAYEINRQAMKLLLESSKINVNIENKNGLTVFDIAVLHNNREIERMVKRHGGKRSVSLVKIKTTSDILASQLSWRESRRTKKIRFYSWISEERRNALLVVATLIVTATYQTVLQPPGGVSDGGGQKSGTSGPKAGSVVMDEVYFIWLWLWNSAGFCFAIEMMIRLLSLGQESMFWYYPLFVPMVLAYSVAGDVIKPNARAYTIAGVGAIVVLIIWGLVVWFWEWVQSKRTKQRGPKSGLVWEGFTTLDQARGVAPNRYVIR

SEQ ID NO: 5087 - protein, 251 aa, Arabidopsis thaliana
MPTLYKKAGSMFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 5088 - protein, 241 aa, Ipomoea batatas
MGRGRVELKRIENKISRQVTFSKRRSGLLKKAHEISVLCDAEVGLIVFSTKGKLFEYSTDSSMENILDRYERYSYAEQRMTTNDSEQQQNWSCQYPKLVSRIELLQRSTRNFLGDDLEPLGLRELQSLEQQLDTGLKRIRTRKNQLMHESISELQKKERALQVQNNILAKQLEQQKLVLNSASTSMPPQPLVSPLPLPNLTIGSIARATEAAKNSENRGQAPPCSTSLVPPWMLRHPNNKD

SEQ ID NO: 5089 - protein, 516 aa, Brassica oleracea
MLYPQVHCSPQFQVIDNKKGFSDTPSKESFFTLESSTASGPLPSYESPSVSITSGRSPFSPQASCISDLHPSPENIYGSPLSGASSHVYDEAHVKNKIRELEVSLLSVDPKVEEYSGFTPAGKSWNWDELLALTPQLDLKEVLVEAARAVSEGDFAAACGFIDVLEQMVSVSGTPIQRLGTYMAEGLRARLQGTGGNIYRALKCNEPTGRELMSYMGVLYEICPYWKFAYNAANAAILEAVAGEKRVHIIDFQIAQGSQYMFLINELAKRPGGPPLLRVTGVDDSQSRYARGGGLSLIGEKLADMAQSRGVPFEFHDAIMSGCKVHREHLGVEPGFAVVVNFPYVLHHMPDESVSVENHRDRLLHLIKSLGPKLVTLVEQESNTNTSPFLSRFVETLDYYTAMFESIDAARPRDDKQRISAEQHCVARDIVNMIACEEAERVERHEVLGKWRVRMMMAGFMGWPVSSSAAFAASEMLKGYDKNYKLGESEGALYLFWKRRPMATCSAWKPNPNQIV

SEQ ID NO: 5090 - protein, 349 aa, Zea mays
MEAVLRHPSLSRTRPPNLNPPTTPSPSLHAPSLLRLRARRLIAAAVFQDQKPKEPASKGGDDEEEAYGEVDRIVSSRTVSSPVFAEDGSATAAVATEFLVEWKDGHEPSWVPAEAIAADVVAEYETPWWTAAKKADSEALAALLADETLRRDPDAEDAQGRTAAHFAAGLGSEECLRALGAAGADEVLARAPKGNPATFQLRQGLEAAQKELEKAVYEWAEVEKVIDGRGEGKWREYLVEWRDGGEREWVKAAWVAEDLVSDFEAGLEYAVAEAVLDKRQAATATAEEEDSWEYLVKWVDIEEATWEPAENVDTELVQKFEQQQSGSAGEVDEVVDKVVDYFGNNFVNF

SEQ ID NO: 5091 - protein, 176 aa, Physcomitrella patens subsp. patens
DRPSEDGYNWRKYGQKQVKGSEYPRSYYKCTQANCPMKKKVERSHDGQVTEIVYKGDHNHPKPQPTRRMALSGAHLLADGLKRNDYSKDVAAAPRTIREPRVVVQTTSDVDILDDGYRWRKYGQKVVKGNPHPRSYYKCTNVGCPVRKHVERASTDIKAVITTYEGKHNHDVPAAR

SEQ ID NO: 5092 - protein, 720 aa, Glycine max
  misc_feature (13)..(13): Xaa can be any naturally occurring amino acid
  misc_feature (189)..(189): Xaa can be any naturally occurring amino acid
  misc_feature (348)..(348): Xaa can be any naturally occurring amino acid
VDKICKALETVNXRSSEILDHPYTQICNEGRQNALSEILEILTVVCETLNLPLAQTWIPCKHRSVLAQGGGVKKSCSSFDGSCMGKVCMSTTDIAFYIIDAHLWGFREACVEHHLQQGQGVAGRAFLSHSMCFCSNITQFCKTDYPLVHYALMFGLTSCFTICLRSSHTGNDDYVLEFFQLRRPPPRVXLPPRITHIHEQKTLLGSILAIMKQHFQSLHIASGVEPEDGSIEIIEATIERVHTRLESIPIASSIKSPPRPDTSPNMGEEVPQDPSEQQILMYCNDINNGGSLGENAARNIDHMPSLETKNINKPLERKRGKTEKSISLEVLQRYFAGSLKDAAKSLGXQHGISRWPSRKINKVNRSLSKLKRVIESVQGAEGAFGLNSLSKSPLPIAVGSFPEPSTPNKFSLPASLSINPSEPQIKENELNASKALETNSQAVMEEDRLLGGRTPHLEKVINDKGRHTREVGKEPKRTRTGSGSSEDSTNPTSHGSCHDSPPNESSPVKNIFITSNNDQCAGLKRSPESTLQLTTNTPNRPAAYPMPDFVAAELQEPFGGMLIEDAGSSKDLRNLCPSVAETILEDMVPEACGTNIPGPDLSPKQSMGTPNKAVTPFVAMKEMKTVTIKATYREDIIRFRVSLTCGIVELKEEVAKRLKLEVGTFEIKYLDDDHEWVLIACDADLQECMDVSRSSGSKIIRVLVHDITSNLGSSCESSGE

SEQ ID NO: 5093 - protein, 519 aa, Physcomitrella patens subsp. patens
MREESAGCLAIFRDLPSSRRLLAVDVFLIVLNPSPSPDWTGFTDGVVEVFSRTSVGTEVPKGQCHCLLSTLIVNLFVLVLVVSFGDDDDGTSADSTKSFKSFEKRELVESVTLLEHDSAEFLQHTGGGGMSRSPHGGGMAGVPSQGLHTPIAIRPPPPPSPGITPSQGGTPGISSAVPNSSPSGPLPIMAVAPPSSAGMSMAMVGPIAGDESRSGSAAATATGPEQSLKRKRGRPRKFSTGESSPIPSGAYPVFPALMPGSSSPYTPSEKRGRGRSQFSGKNQQLAALGVVLAGTGQGFTPHILTVNTGEDVATKIMQFAQHGPRAMCVLSANGAISNVTLRQQSSSGGTVTYEGRYEILSLSGSYLPTDLGGGARQRTGGLSVSLAGIDGGVIGGGVAGMLTAASPIQVVVGSFLSDTFRNKPRPDSPFSAALGRSPGVGSPLGSFSGTPRPTPPRPEPKPSPASGPQQASPDTPTGQSSVQRPQAMSIFQPTTWQFPLVPGDGRKTDINISLPDGFS

SEQ ID NO: 5094 - protein, 114 aa, Humulus lupulus
YQTQIVGWPPIRSFRKNTMASNLAKTNEDTEEKSGLGCLYVKVSMDGAPYLRKVDLKTCTNYLELSLALEKMFSCFTIGQCSSPGLPERNGLTESRLMDLLHGSEYVVTYEDKD

SEQ ID NO: 5095 - protein, 221 aa, Arabidopsis thaliana
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATMAIPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 5096 - protein, 250 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMVKEAYCEMLTKYHEEL

SEQ ID NO: 5097 - protein, 269 aa, Oryza sativa Japonica Group
MSSASSMEALHAAVLKEEQQQHEVEEATVVTSSSATSGEEGGHLPQGWAKRKRSRRQRSEEENLALCLLMLARGGHHRVQAPPPLSASAPPPAGAEFKCSVCGKSFSSYQALGGHKTSHRVKLPTPPAAPVLAPAPVAALLPSAEDREPATSSTAASSDGMTNRVHRCSICQKEFPTGQALGGHKRKHYDGGVGAGAGASSTELLATVAAESEVGSSGNGQSATRAFDLNLPAVPEFVWRPCSKGKKMWDEEEEVQSPLAFKKPRLLTA

SEQ ID NO: 5098 - protein, 277 aa, Vitis vinifera
MENHVSQQNLAATNNPFLPGGAGDGSFGSKIHGEDKKLRLFGFEVDLYCKGAELQGGSELDETANSPDVALSKMEKSVEKPEHKKYECQFCLKEFANSQALGGHQNAHKKERLEKKRLQLQGRKGSLNFYFQPLRSDVGFIYHERFLALVRIWDGKLAVIEDSVAEFLAVREPNYISAGDNAGAGELEGGLGADDEVEGIAREGEVDVGVALGGVEGVGADENRGVAAIDHAVVEEEAESAGGGGGAVDLLAGNRILHDAFKVWTGLLVVVDIELGL

SEQ ID NO: 5099 - protein, 762 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQVYLGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 5100 - protein, 363 aa, Solanum demissum
MDEVMLPGFRFHPTDEELVGFYLRRKVQQKPISIELIKQLDIYKYDPWDLPKLAAVGEKEWYFYCPRDRKYRNSARPNRVTGAGFWKATGRAAKGIKTDWMMHEFRLPSITDSTAPKRFLDKHIPPNDSWAICRIFKKANSNAHRALSHSWVSPPQVLPQNNTTSHDFLTSSHFTNNSNEMSSFIHKTSSTSPIQFNDLLQNSSNNNMSSSFTTLDLPLYKTLNSMSNHNNDPITSYTFSSSCVDNMNNIDASSLLLNMSSSIFGDYSIALPENIEGGGVHDDTTTTTFKEANNVIINNMEHMEELQWGNAVRSNNIGVIPLMNNFPLNMAADAWKTNLLWDSSSPCPSSEMSTSYSTNKCYT

SEQ ID NO: 5101 - protein, 243 aa, Glycine max
MGRGRVQLKRIENKINRQVTFSKRRGGLLKKAHEISVLCDAEVALIIFSHKGKLFEYATDSCMEKILERHERYAYAERQLVANDSETQENWTIEYTRLKAKIDLLQRNHRHYMGEDLASMSLKELQSLEQQLVTGIKNIRTRRNDLMSESISELQKKEKRIQEENNTLAKKIKEKEQAVAQQAAQWEQPNYRVDTSFMPQQQPLPTSLNICGNNYCQEAAPELGRNGLDLTLEPLYSCNLGCF

SEQ ID NO: 5102 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHMRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 5103 - protein, 103 aa, Brassica napus
  misc_feature (15)..(15): Xaa can be any naturally occurring amino acid
DDDFLRLKVSYEEEXKIRFRMRNSRRLKDLLWEIAKRFGIEDVSRYDLKYLDEDNEWVLLRCDDDVEECVDVCRSFPGETIKLLLQLSSQHLQERSSISGSLS

SEQ ID NO: 5104 - protein, 301 aa, Solanum lycopersicum
MNKGANGNQQLELPAGFRFHPTDDELVQHYLCRKCAGQSIAVSIIAEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETTSFGEFDEEIKPKILPTQLAPMPPRPRSTPANDYFYFESSESMTRMHTTNSSSGSEHVLSPCDKEVQSAPKWDEDHRNTLDFQLNYLDGLLNEPFETQMQQQICNFDQFNNFQDMFLYMQKPY

SEQ ID NO: 5105 - protein, 454 aa, Triticum aestivum
MSSHGVVAVKPITTPDKTTHSYACGSTQSSVHKLLDSKLDHLGLLDDNLSSTSQSSDIKTELIRTSSLGRSSLPFNLQRRSPEPDPESPLSHVSHPNFSEPMASNSSTFCTSLFSSSSTNSEPCRRMGALPFLPHPPKYEQQVLPGQSSTSSLQLSGDTGNVHDEAEQADDIKDFLNLSAGDASDGSFHGENQAFAFAEAEQMEFQFLSEQLGIAITDNEESPQLDDIYDTPPPQMSSLPVSSCSNQILQNPGSPAKLPLSSSRSSSGSAAANKSRLRWTLELHERFVEAVNKLEGPDKATPKGVLKLMKVEGLTIYHVKSHLQKYRHAKYIPEIKEEKKASSDLKKVQPGSSGSDPFKNKNLAEALRMQMEVQKQLHEQLEVQRQLQLRIEEHAKYLQRILEEQQKVGSGSSLSLKTPTEPSESTSKDRTEPEEATTSSPQTSKNSEAGSPCS

SEQ ID NO: 5106 - protein, 201 aa, Zea mays
MDMAMSQHSSDTSSTSSYSSDPSSTSSTSNGKKRPHDGAAAAAPAYRGVRMRAWGKWVSEIREPRKKSRIWLGTFPRPEMAARAHDAAALSVKGARAVLNFPALARHLPRPASLAPRDVQAAAARAAVMHEPEPQRPDEPGRQPVEEVVVAAELVFDDLAPLWVEDVVELGPCPSQHSSWTPCDGLDAAACLHSLPLLWDY

SEQ ID NO: 5107 - protein, 315 aa, Arabidopsis thaliana
MDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 5108 - protein, 411 aa, Zea mays
  misc_feature (50)..(50): Xaa can be any naturally occurring amino acid
  misc_feature (100)..(100): Xaa can be any naturally occurring amino acid
FPARPRVRKFVLQSQEQMSFRNNLTESTDSDSTVQKQMTRPPSPNAKAHXPNFQPRPAMDNWMPLGRRETDFKDTRSAFKDARTASQSFGDTQGFFMQAXGPTSRHRLSFNNQFQDQGSAHRFADPYFYMPQQPSLTVESGTRTQTANNDLRFWSERNSMYGNPSDQQQGFSFGQNPSSWLNQPHPQVEQSRVVRPHATVAPFDLEKTREGSGFKIFGFQVDTTNPSPVQLSSPLSAIREHVVQTRPSAPVNESQPVQIECLPEVSVSTAGTAAENIQQVQQSSKDIQSKSQGVSTRSCTKVHKQGVALGRSVDLSKFTDYGELKAELDKMFEFEGELVSANRNWQIVYTDNEGDMMLVGDDPWEEFCNIVRKIYIYTKEEVQKMNSKSSAPRKEEPPAAGEGCAQEFGTR

SEQ ID NO: 5109 - protein, 151 aa, Triticum aestivum
MAPRTSDKTATPPAAGAAATGLALGVGGGNGGGVGTHYRGVRKRPWGRYAAEIRDPAKKSRVWLGTYDTAEEAARAYDAAAREYRGNKAKTNFPFASASAPPAAAAALTGDGSRSSNSSTVESFGGDVQAPMQAMPLPPSLELDLFHRAEL

SEQ ID NO: 5110 - protein, 190 aa, Physcomitrella patens subsp. patens
MKDPVDGILRICSEALREDFSRDHPEKPNECRQRLHRRTVSPRRPAQRGQLPERAVAILRRWMFEHFLNPYPALEEKCFLARKTGLTRQKVSNWFINARVRLWKPMVEELYEDEFAPRATLVVDSVLNRDHCGDNESTRGAGLELGACCLNTEQKPSSSEPDGSRDLDDRALAVPGLLLSLLSLIEIQRP

SEQ ID NO: 5111 - protein, 760 aa, Candida albicans SC5314
MIMNMTTDYRDPLLDLFGTESNSGNETSSPSDIPVINRSGTFNQQQFSPLLTQQSLYNTPNSGSTPNIFDPNYTQMQEEQTSPSSNKLQPEDPPRKKRNTRSQTKIHQQSEGDEYNSNDYKDSIDLDKPPVVEPSPPFFVESDTTPEFVIPTPTSEQQQQQHHELIAQDYQRSNNSNQFGNLTHYEPNLPPLPPLSESILPQTNTFHPLVLPHDPRHAITAGPANNSQQQQQRQQQDSSIPSDGISSKIQQLHAPSLSNNQSASQRKKKESSGPKTRPAFVMKIWSMVNDPANHEYIRWNDDGKTFQVFHREDFMKVILPKYFKHNNFASFVRQLNMYGWHKVQDVANGTLNQNSDKNGQDEIWQFENPNFIKDREDLLDKIVRNKSSSNQDDVSGVSFNGINNSANLSLILQELETIKMNQYVISEDLRRVRQDNKMLWQENYLNRERNQVQGRTLDKILKFLSVVYGNNANKILNGHGFADFSDSNNIMTQYRPSPMGSPLLSRPQTQPPPSNSRFARDNNQTAQPTYESPLSTSDTNNNNNNTFEYQQAVNRPRLMLTNRAHSRRPSMSRTKSTPEGSIEEIIRSYSNDKAAESNVNRMYEQLVGHQPGATTNNNNHSSSTAISAPSPRHSFLQELNLPGTPRNLDDLEKHINKEGQSIQQVQDWIDKLAQEQHEKQQQQQGNDDDDDFDVNEFLKDATTTPSSNVPNGGHYNNGNISFVGSPIAMTPGSNVSSNINDSDGNEKKSKKRSIEEVSDH

SEQ ID NO: 5112 - protein, 63 aa, Physcomitrella patens subsp. patens
DEREVKRQRRKQSNRESARRSRLRKQAECEELGNRVETLTAENMTLLTELNRMTEECKRLQAE

SEQ ID NO: 5113 - protein, 999 aa, Oryza sativa
MSSVMMTSDNGKAPEKGGEASGPSSAPQEGEISNEPQRRRPLSGRTTGPTRRSTKGNWTPEEDSILSRAVQTYKGKNWKKIAECFPDRTDVQCLHRWQKVLNPELVKGPWSKEEDDIIVQMVNKLGPKKWSTIAQALPGRIGKQCRERWHNHLNPGINKEAWTQEEEITLIHAHRMYGNKWAELTKFLPGRTDNAIKNHWNSSVKKKVDSYMSSGLLTQVSCLPLNEYSAHCNSSPALTQQNSEDSGSYAVREVENSSVCSQSSLAKVSCSQVHNANVALGCDLQVNANVDNNEAHDSQSSVGHEACYTSVGAVATAIPEVHYHVSSSNFDPDQHLQEEFAQGLNLHMSMDEVPSNSSFADNPTICSIENHERSLEPYDVAMEMPLSMLPSDSGAEQKLHFMSEADFNSPNCLKSELWQDISLQSLLSGPDAVETDSFSRSNHQSDVYSSQADNEFLAPPYLLQTSNSSSVMEATYGQSPQMSVPPSLICSNVMTDVPSDNRSEPKEMTVSQAEMVTQSSSSSGDAEMSANPVSSNGSDIPSMMERIPECADQHVTNAEEPEASIEKEPSVTPSATADEKQDEGALFYEPPRFPSMDVPFVSCDLVTSGDLQEYSPLGIRQLMRSTMNVCTPMRLWGSPTHDESPDILLKSAAKSFICTPSILKKRHRDLVSPIPDKRIEKKSGTEKDCGVSDTSSIGIQTCFINATKDDAVITKSVLRIERSASSKPLEKKLEFSDENKENLDNTIEQAKDGQSAGNYKHIDEQARGERRTATNITTTYDDPPGNLQPAGILIEHNGDDLVSPDYGKNTMKQKQNTNMESLSVCKEGVSAKKPAELIVEKSSACINVDYEYVNILADTPGIKRGLESPSAWKSPWFVDMQFQGSYFVSPANGSYDALGLVKQINVQTAAALAEAREVLASGGQSENINSDKENLENPDAKKEPGATTKLQAKIKTEGKILDFNECATPIRSSDKKAGSSLGRSLSSPIPSSHLLKSFR

SEQ ID NO: 5114 - protein, 246 aa, Oryza sativa Indica Group
MGRGKVQLKRIENTINRQVTFSKRRSGLLKKANEISVLCDAEVALIIFSTKGKLYKYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 5115 - protein, 168 aa, Brassica napus
MAPTVKTAVVNTNGGDGGIKETRYRGVRKRPWGRYAAEIRDPYKKTRVWLGTFDTPEAAARAYDRAALRFRGAKAKTNFPYTYMVDNNESPTQSSTVESSSIPDLNLGSVGSKFPFPKVQVKPGMILFDEESTRSESDSSSVVMDRSPERRSRVLLDLDLNLPPKPED

SEQ ID NO: 5116 - protein, 454 aa, Zea mays
  misc_feature (94)..(94): Xaa can be any naturally occurring amino acid
  misc_feature (128)..(128): Xaa can be any naturally occurring amino acid
  misc_feature (136)..(136): Xaa can be any naturally occurring amino acid
  misc_feature (151)..(151): Xaa can be any naturally occurring amino acid
  misc_feature (372)..(372): Xaa can be any naturally occurring amino acid
MATPDWSGFQAYSPMPPPHGYVASSPQTHPYMRGVQHMIANYMKLLLVLIEMEKSSKEKEPKTPPPSSTAPPSSQEPSSAVSAGMATPDWSGFXQAYSPMPPPHGYVASSPQPHPYMWGGSAYEWPPXYGTPPHPXYLQCIPPGGMYAHPXSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARXRSRLRKQAECDELAHRGEMLHKIKGPRDSCAHIGKGGLCESYVRGFTWRQVDVLPGDTVGLRHGFARSAAVLSPLQFYLYCV

SEQ ID NO: 5117 - protein, 225 aa, Nicotiana tabacum
MAVKNKVSNGNLKGGNVKTDGVKEVHYRGVRKRPWGRYAAEIRDPGKKSRVWLGTFDTAEEAAKAYDTAAREFRGPKAKTNFPSPTENQSPSHSSTVESSSGENGVHAPPHAPLELDLTRRLGSVAADGGDNCRRSGEVGYPIFHQQPTVAVLPNGQPVLLFDSLWRAGVVNRPQPYHVTPMGFNGVNAGVGPTVSDSSSAVEENQYDGKRGIDLDLNLAPPMEF

SEQ ID NO: 5118 - protein, 291 aa, Nicotiana tabacum
MASPQENCTTLDLIRQHLLDDNVFMEHYCPQPILYSQSSSSSESLNSIASELNNETFSFEPTLKYADTAQSSNLDISSFFNNSKTEFDSFEFETKPNVSAARISSNSPKQTSFKERKPSLNIAIPMKQQEVVQKVEVVPTEKKHYRGVRQRPWGKFAAEIRDPNRKGTRVWLGTFDTAIEAAKAYDRAAFKLRGSKAIVNFPLEVANFKQQDNEILQPANSGRKRMRETENEEIVIKKEVKREERVPAAAAPLTPSSWSAIWEGEDGKGIFEVPPLSPLSPHMAYSQLVMI

SEQ ID NO: 5119 - protein, 205 aa, Zea mays
RNGLLKKAYELSVLCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 5120 - protein, 73 aa, Chlamydomonas reinhardtii
QVEGCGHDLTTEKSYYQRYRVCEPHLKLLSLMVDGKPCRFCQQCGRFHELNEFDGNKRSCRARLIQHNARRRK

SEQ ID NO: 5121 - protein, 222 aa, Pinus resinosa
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGISRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 5122 - protein, 185 aa, Pharus virescens
EMRRIENKINRQVTFAMRRNGLLKKAYELSVLCDAEVALIIFSNRGKLYEFCSGQSMTKTLERYQKCSYGGPETAIQNKENELVQSSRNEYLKLKARVENLQRTQRNLLGEDLGSLGIKELEQLEKQLDSSLRHIRSTRTQQMLDQLTDLQRREQMLCEANKCLRRKLEESNQVHGQQVWEHGAN

SEQ ID NO: 5123 - protein, 64 aa, Triticum aestivum
  misc_feature (30)..(30): Xaa can be any naturally occurring amino acid
  misc_feature (37)..(37): Xaa can be any naturally occurring amino acid
KLDDALAASFIAPQQDSLEDDNQLTIDEYXRSWELNXELGLNDMNTSSAYMAYNTTSTSKSLLV

SEQ ID NO: 5124 - protein, 296 aa, Saccharum officinarum
MSGGGQDLQLPPGFRFHPTDEELVMHYLCRRCASLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAASSGDHKPMVFAAGAVSSPPEQKPFVATPGGLPPAAFTADLAAYYDRPSDSMPRLHADSSCSEQVLSPEQLACDREVQSQPKISEWERTFASDPVNPAGSMLVDPVVGGHAGDPLLQDILMYWGKPF

SEQ ID NO: 5125 - protein, 261 aa, Physcomitrella patens
MVEKVVVSSLRRKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 5126 - protein, 351 aa, Glycine max
  misc_feature (141)..(141): Xaa can be any naturally occurring amino acid
  misc_feature (166)..(166): Xaa can be any naturally occurring amino acid
SGFTRKARTPRSNNKHSSLQQQQQKPLHEEQGEEEEVFFNNTIISVQPLVPELGSEEPLLNDETEEQLLCRVPVFDAELCSIYNEVKDEVNVAGGEVAFDLENFSSEFLPTDMDLAEFSADVESLLGNGVDEDSPVKKGSXLVLLDCKEEGDDEMDACVNGIGATXDAMVKVKDEEELDADDDTACHLDSILDMNSEAFNWNIAESESPAQAQEDEVSKVRTNKKDIFLRLNYEEVITAWASQGSPWTTGTPPKFFNSDDCWLDLGSNGGGVQCYYGEVRSLRVHADGGREARVSRYREKRRTRLFAKKIRYEVRKLNAEKRPRMKGRFVKSVPLLEPLLCQLNHQSSPLT

SEQ ID NO: 5127 - protein, 559 aa, Candida albicans SC5314
MSSLQQPIPPNSTLATTASSNQSGSNDFVKKLFLMLQEDSYKEVVRWTVKGDSFVVINTNEFTKDILPKHFKHSNFASFVRQLNKYDFHKVKISNEAKASYPYGEDAWEFKHPEFRINDAEALENIKRKGPTAKKSASNVTIKTEANNNGTQPTCNHNYSQLVSATNHLKEQVESLKNDKHSLYQEISVLERKYKTVVENIVAINTFNERYYRSMNVLINSIVQNGMKLPPLDFPPPVQLGPDSGIGSNLGPISSDTALPSISHHLSSPLPHHQQLLNRTIRPISSPIDGIPLVKLQQQSLGQNLQAPIGTPSAVPFSEEASSSIQAATPAPLAQPVAQPINQPPPPPPPPATQQQPLPPPPPPATATSQIPSAPPPPTQQQVGTSSSSVPTISPKSQGIVVSNSASPTTSAQISTTSVPNPKFHVLLVEDDNVCIQLCRKFLVKYGCSVTVVTDGLNAISTVEHTKYDLVLMDIVMPNLDGATATSVIRSFDTKTPIIAMTGNIEDNDLVTYLQNGMSDILAKPFTKDDLYAILSKHLLDPKENKQDNEPTVKKQKLS

SEQ ID NO: 5128 - protein, 684 aa, Zea mays
MVFQKRSSSELEASGGGQVAEMPRVPKSARGKRSVRKKEAQNPPQMSAFDLLATVAGKLLDEGVGSLGNMSAGAPALTACAKDVRVKKEQCDEEMKQFKHEVTDQDSCNESAILPHIVFQRAVNNARNEDPKAKSEAQDKESSMISCTKAELGCNFGVIADRWSPESVESGAFTGDAVASLMPPAPAGFHKNAPEMYNLLDSMDVDVKPPPLVSSDSTGEMPLYGDKVHRSTSLPRVSKGVGFFPVDRDDDDDKSSGCTHPSTTTNKDFRSNCTAEYSRVRKLLTSKYRKVAPARVYKSDLSYSDVDRKPSFRNKKMHYTRQRTQRSTFKRRKLFDRHSVLASEFGTAHGKGNTKKVTGRDSHAVSLEANKGTSSTPFQKSRGSNDCHVKLKIKSFKVPELLVEIPESATVGSLKKTVLEAVTAILGGGLRVGVLHHGKKVRDDNKTLIQAGIGQEDMLDNLGFSLEPNCTQNPQVQAPEDISFLETIDTAEPLARIAPADSSSKHGEVDLSQEFALTPLAMNYQGSDHDSVHSPGGVSSPDKVSTNSRALVPVPAADPNAGAIVPANKSKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLLAEARLLT

SEQ ID NO: 5129 - protein, 76 aa, Physcomitrella patens subsp. patens
KRLREPRYAIKTRTDVDVLDDGFKWRKYGQKAVKNSPHPRNYYRCTTPLCPVRKRVERSNEDAGLVITTYEGTHSH

SEQ ID NO: 5130 - protein, 340 aa, Zea mays subsp. parviglumis
MGRAPCCEKVGLKRGRWTKEEDQILANYIAEHGEGSWRSLPKNAGLLRCGKSCRLRWINYLRADVKRGNISKEEEDVIIKLHATLGNRWSLIASHLPGRTDNEIKNYWNSHLSRQIHTYRRKYTAGPDTAPIAIAIDMSKLRSAETRRGGRTPGRSPKSASSSSMTKSKQPDPEPEPESGGASSPRHSDGARSAVVDPDPDPNQPNSSSSGSTGEGEDATGPWLLDPVELGDLWEAESEMDALMSIGGNAHDSATAEGFDAAQAQAQVDDLFDDMDWDNFAAHLWGEPEQQTDHSAQPQPQQAAEPQAAAAAAAAAEAVACDPDEHELEALETWLLSDSF

SEQ ID NO: 5131 - protein, 521 aa, Glycine max
  misc_feature (197)..(197): Xaa can be any naturally occurring amino acid
MSTPNTDSGTAPPPRPTITLPPRPSAEAFFSAAAGASPGPMTLVSSFFGSDAAADCRSFSQLLAGAMASPMAFSAAAAAADNSGKDDDGPHKGFKQSRPMNLVIARSPVFTVPPGLSPSGFLNSPGFFSPQSPFGMSHQQALAQVTAQAVLAQSHMHMQADYQMPAVTAPTEPPVQQLSFALNEASEQQVVSCVSSXPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKFSEKIPDSSVAKSDQTSNQGAPPRQLLPGSSESEEVGDVDNREEADDGEPNPKRRNTDVGVSEVPLSQKTVTEPKIIVQTRSEVDLLDDGYRWRKYGQKVVKGNPHPRSYYKCTSAGCNVRKHVERASMDPKAVITTYEGKHNHDVPAARNSSHNTASSNSMPLKPHNVVPEKHPLLKDMDFGSTDQRPVHLRLKEEQIIV

SEQ ID NO: 5132 - protein, 267 aa, Oryza sativa Japonica Group
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 5133 - protein, 447 aa, Oryza sativa Indica Group
MSSKAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAVGQLLSRRLVVVPEEAAGSGGDSPEERKDEGEIVEEQEQLLYRVPIFDPALSEFCSPPPLEDAAAAVSCCNEDGAVENPTKPSMTTTTATTPPLQFFPDGHANFGPTDAELREFAADMEALLGRGLDDGNDEDSFCMETLGLIEPVDDDAGRVKVEADGDAGMTLAWCHELDTETSSGEMLDIDFDYGSPQAATTPDEKVGSSGPAAAADDDAQFQQSSLALSLNYEAIIESWGTSPWTDGERPRVKLDDSWPRDYSGVWMAAAGVFGHGGEEQALTPRLGMDGGREARVSRYREKRRTRLFSKKIRYEVRKLNAEKRPRMKGRFVKRAAAAAAVATACVA

SEQ ID NO: 5134 - protein, 194 aa, Triticum aestivum
MDGEWSDGAVSGGEQKASGDGVSADRNSPGSPSPPAVPSTSGRRRSLQKRVVTVPLADLNVPRPKGVGEGNTPTDSWAWRKYGQKPIKGSPFPRAYYRCSSSKGCPARKQVERSQADPDTVLITYSYEHNHSSTAARAQSRPTPTPKPSKERPLPSPEPAKSDGTHHGTADVSRGLVTASPAPAIEVHDDIRWL

SEQ ID NO: 5135 - protein, 238 aa, Carica papaya
MGRGRVQLKRIENKINRQVTFSKRRSGLLKKAHEISVLCDAEVALIVFSTKGKLFEYSTDSCMERILERYERYSYTDQRQTVTNEIGPNGNWNLQYAKLKARIEVLQRNERHFLGEDLDSLSLKELQSLEHQLDSALKHVRSRKNQLMLESISELQKRDKALQEQNNALAKKVKEWEKELAQQAQITWEPHAPALHPSSNIRSYPPMSNGEDEEGNVAQQRATGSTLLPPWMLGQINE

SEQ ID NO: 5136 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKVLAHPQYPSLLGAYIDCQKIGAPPEVVARLDALTHEYENQQHRTTVSIGMDPELDQFMEAYCEMLTKYHEEL

SEQ ID NO: 5137 - protein, 508 aa, Oryza sativa
MMAEALREVLPLPYFPGQPCWYLQERRGAEAWSAEENKVFERALAQVDLDSPNRWEMVAAMLPRKTVIDVMNHYRDLENDVGSIEAGLVPFPHYSSSLSPASSGFTLQDWDGSDGGFRRGCYLKRGRAPDQERKKGVPWTEEEHKSFLMGLKKYGRGDWRNISRYFVTSRTPTQVASHAQKYFIRLNSGGKDKRRSSIHDITTVNLPEEDTSNPSPSPPSVLTTASDQLGSLVDTKPVPPPPSLGAQRHFMSPLPGALGVSHHPYGNVKLEPNASFLAGGDAMRTLVTAVLSGGEPHKEEHRAPPPIISTGTTRLRPSRSPVSVCDWLASWLQSCFMRLRIAKYWTEGPLTGYCFDQEHQGFPRKRKRKALLDRCDYTIHCMNLSLDCLFGKPHRPASAGGQCISTPTPSAIPIPDRMHGEIGDHRPEIKWHRCYCRFVLCSSDFCSCEVEESASTGGGALLSSICSAIGHGRESESIIDAIALLGRHVRPRLRANIQILQMDDIIEE

SEQ ID NO: 5138 - protein, 222 aa, Eupomatia bennettii
KRRMGLLKKAHEISVLCDAEVALIVFSTRGKLYEYSTDSCMSRILDRYERDSYAERELVVSGLESEGSWCLEYSKLKAKVEALQRNLRHFTGEDLETLSLKELQQLEHQLDAALKHIRSRKNQIMSESIAELQRKERLLQEQNQMLEKKVQEKEKAMAQQAQWDHQNQSQSSLSFLLATPLPTLNIGTYHQANGVGAEEEGARRSARTNSLMPPWMLRHVNE

SEQ ID NO: 5139 - protein, 236 aa, Magnolia grandiflora
QLKRIENKINRQVTFSKRRMGLLKKAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRKNQIMFDSIAELQRKEKSLREQNNMLEKEIQEKEKAMAQQAQWEQQNQSQSSPSFLLASPLPTLNIGTYHQGNEVEEEGARPPARTNSLMPPWMVRHVNE

SEQ ID NO: 5140 - protein, 648 aa, Nicotiana tabacum
MVDLLGSNSQLKHFEGDNALCREIWRACSGSLLDVPKLGERVHYFPRLHMDQLEQSSNLEWIQGLQLSHLPRKILCRVLHIRLLVEHDTEEVYAETILLPNQEQNEPSTPEFCPLEPPRPQYQSFCKALTTSDIKSNWGLSVHRKDANKCFPPLDMMQEKPTQELIVNDLQGNEWRFKHVFQGQPRRHLLKHGWSTFVTSKKLLAGDLVVFLRDETGKLHVGIRRLSYQCNSVGSSTFSRQSMEGVLAVASHAFATRSLFSVYYKPCYNRSSQFIMSLSNYFEGGNHGPGVGTISRTQHTSLDSHVKRTSGMDQMSFPQGQHKTNLLLEEDQYMQDSEAISNSARPTMMALEIGQQSVESLNNIHHIEDSVLQPHTAVARENNERFIPNETVAIQAQDENFDELFKETDFPDFVNTSLDTITLDWDSDLRSTIQDFDEWLEETNPPGLQTCSEDHSRQTSSILEQPTSSQVMSISSTPSRIPYEGPGRGDEQVPWGSYQVARRCLPILNRVVSRYPDSLVNFKVTSSIFQSVCLEILAELVYFLDNLTVMNLSKDQFNVAGQHLWDLKLSGIELGWLEKRLAHIDGAFSMENLLQRRQVVTLRMGDTLATFRQLDEELGCINKELHQLSLKVGPNPPMRFHPVLEGLL

SEQ ID NO: 5141 - protein, 215 aa, Oryza sativa Indica Group
MDGDAWWCPGAGGGGGSNNWDLGAVVRKKQTRKEVVRVAASGPAPDSWAWRKYGQKPIKGSPYPRGYYRCSSNKNCAARKQVERCRLDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 5142 - protein, 235 aa, Streptochaeta angustifolia
EMRRIENKISRQVTFAERRNGLPKKAYELSLLCDAEVALIIFSSGRLFEFSSASCMYRTLERYRTCNYRSHEAAAPIETESNYQEYLKLKTRVEFLQTTQRNLPGEDLGPLNMKELEQLENQIESSLKNIRSTKNQTLLDQLFDLRHKQQQLQDLNKDLRRKLQEVGGHDNALQVWEDGGPSGSAGHEHLQGLLQPSEIDPSLQIGYHQAYLDQLNNGQIAQYPNGHLPSSAPWI

SEQ ID NO: 5143 - protein, 281 aa, Triticum aestivum
MSDCSTGTDSPRADSVDEQPPADAESPGGGQSKRDHPSPSSPLPPPKRSRRSVEKRVVSVPIAECGERAKTNGEGPPPPDSWAWRKYGQKPIKGSPYPRGYYRCSSSKGCPARKQVERSRADPTVLLVTYSYDHNHPWPAPKTGCHPNKSSPRLVDPKPEPGTPVECQPEQGPEAPEQEQEEEHEQKPVIGLADPAAITTVTAAAEEEEESFDFGWFDQYPTWPRTALYVPAFDVAPPPEDWERELQGEDALFAGLGELPECAIVFGRRRELALAATAPCS

SEQ ID NO: 5144 - protein, 311 aa, Oryza sativa Japonica Group
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQVCSISPSLQEPCTCNIFFPL

SEQ ID NO: 5145 - protein, 203 aa, Solanum demissum
MDILGNLYIDPLPLVIPTTTSSTTFDNNSNEKVMLLLASKIPKRRGDRKKFHETRHPVYRGVRWKNFEKWVSEVRVPAKKSRIWLGTFPNAEMAAKAHDVAVMALKGRSACLNFADSTWRLPVPASAAVKDIQKAAAEAAEAFRVSESLERENSEEVVINNDDHYVVDSGWRLVIPASAVARDIQKAVAEAFCPSESSKGEYF

SEQ ID NO: 5146 - protein, 296 aa, Oryza sativa
SDPLLSVKFYERTREQQAALGFLVEPSTEEPGDQPVNHASTVEGNSEVLQEPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNGKDLTRDVIKSDSAGVKVPELELELASGTLGGIVTTVEGLIVKICEALQRVHGFHLGDSTLEWKKKKWEDFNDRLSKLLSLQEPWTLIIDDGLAASFVAPATDSLEDDNQLTIEEYVRSWEQNEELGLNDMDTSSADAAYNTTNP

SEQ ID NO: 5147 - protein, 261 aa, Vitis vinifera
  misc_feature (58)..(58): Xaa can be any naturally occurring amino acid
MAVWKDTISFRLDIAPDSNGGITALIHSPVGMNLNEMLGGEEYKYSPMAAVDDGSLAXLNSIATARKKKEKNKRRFSDEQIRLLESMFESETKLEPRKKLQVAKELGLQPRQVAIWFQNKRARWKSKQLERDYSILRGNYNSLVSRFESLKKEKQALVIQLQKLNEMVQQSGGAKQDSEQRLVQNSAESEADNRDNGNCESEVKPNLSLERSEHGGGVLSDDDSSIRADYFVMEEEPSLLTMVEPVDGCLTFTGRLGQLGL

SEQ ID NO: 5148 - protein, 393 aa, Oryza sativa Japonica Group
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 5149 - protein, 209 aa, Zea mays
MVRMKQVKISVKKDVDSYTIRGTNKVVHVGDCVLMRASDSDKQPYVARVEKMEADGRGSVRVQVRWYYRPEESKGGRRQFHGAKELFLSDHFDLQSAHTIEGKCVVHSFKNYTKLDNVGPEDFFSRFEYKAATGSFTPDRVAVYCKCEMPYNPDDLMVQCEACKDWFHPSCMAMTIEQAKKLDHFVCSDCLKENGSKRLSNVYATSSNS

SEQ ID NO: 5150 - protein, 315 aa, Brassica oleracea
MTRRCSHCNQNGHNSRTCPNRGVKLFGVRLTEGSIRKSASMGNLSHHSGSGLSGLVSNNPGSPGNGPDHDGYASEDFVPGSSSSHRERKKGNPWREEEHRMFLLGLQKLGKGDWRGISRNYVKTRTPTQVASHAQKYFIRQSNVSRRKRRSSLFDIIPDEATDSVPAAPLILETEECESMKSTNSVGVEAPEDSIQTQLQPPPPGSFPVLYPAYFSPFYSFPFPVWPAAYDTEPAKEETHQILRPTAVHSKAAPIKVDQLLGMSKLSLKESSQNGVSEESLSLKLVGGSSSRQSAFHPNPASDGGSDMNTVIHAV

SEQ ID NO: 5151 - protein, 91 aa, Chlamydomonas reinhardtii
YCECFASSRYCEMCNCMQCFNNRENEAVRQSAVEAIMERNPNAFKPKITVRGHETHTPVVVAAAGASGRHLKGCNCKKSFCLKKYCECFQV

SEQ ID NO: 5152 - protein, 692 aa, Chlamydomonas reinhardtii
MRQWRGFKTVAIGTGVGTVQSSQSLLTALLPPALLWLLCVLPSSYRSFLLRLWGYDPACKAGGFGGTASADSASPSSVTSPIAAALTWLIAQLHLTGLVSALADELALAARALYLCMLFLPALVTAPLASLGGAAARERWLRLVQWTLENAGPAFIKWGQWASTRPDLFPEDLCLHLEQLQTSAPAHSAAHSIATVQAAFDSPLGELFEVFSEQPLASGSIAQIHVATLSEKGAALVGGGATAGATVAVKVRHPGVTGIMHRDFILMQRAAALCSRLPGLAELRLEVSTDVLVESFEEGDLITRYVRSPHRHNAMLAQTGVDVFLTMMLKDNFIHADLHPGNLLVRPADPPSAAAVALASWLPASWARARSWLVDRSPAIVLLDTGMIVELSNQTQKSLMGFFKALTHMDGRRLAREILAMSVDGNCKVTLRSSVSTVVVTSLVLEGWSSKLDPDVRILDTMRDMLGTDNWAERLGGVVDRVPEECKSCAFGAGARSRRSGAGEQQLTAGLPISEGSARLRKASRLEENKVFEVALARHYADVDRFERIASYLPNKTPNDIQKRLRDLEAPNAKRPKTDVPANGDRRKGVPWTEEEHRLFLLGLAKFGKGDWRSIARNFVISRTPTQVASHAQKYFIRLNSMNKKDKRRASIHDITSPTLPASVANPAPTTGLAPAAASGKATSSLLPAICV

SEQ ID NO: 5153 - protein, 126 aa, Actinidia deliciosa
  misc_feature (24)..(24): Xaa can be any naturally occurring amino acid
IENKINRQVTFSKRRSGLLKKANXISVLCDAEVALIVFSHRGKLFEYSTDACMEKILERYERYSYAERELVNDPETPFLNVQKNWSLECTRLGEKIELLQRNIGHYMGQHLDSLSLKDLQHFEQQL

SEQ ID NO: 5154 - protein, 218 aa, Oryza sativa Japonica Group
MAKTRQPQKRVLESFTIKGPDGVIKPGDTVLMMAPDSSKKPYVARVEEIEATGPQASQVKIKVRWYYRPEESIGGRRPFHGSKEVFLSDHYDSQSADTIEGKCYVHTFRDYTKLRSVSAEDFFCRFEYKSATGSFVPDRIAVFCKCEMPYNPDNLMIQCEDCSDWFHPSCVEITIKEAKKLEHFYCKSCIAENGKDLQKSNGATVQSEEKVQSKRRRR

SEQ ID NO: 5155 - protein, 497 aa, Zea mays
MAAREASAPAPASPHAGDGPGRPPRPTLALPPRSAVESLFATGASSSAGAAETSPGPLTLAAALFPDASSPAFHGSFTQLLVGAIGSPAVPSPPSPFAVPPGLSPATLFGSPGLFSPTGSFEMSHQQALAQVTAQAVHSQYNMINHTDYSIPFSSTTAPALITAQHANSSANVASAQEKPALPSHAGNSNIESNEVSQGLKTSAPTFDKPADDGYNWRKYGQKAVKGGEYPRSYYKCTHTSCPVKKKVERSAEGHITQIIYRGQHNHQRPPKRRSKDGGGPLNEADVLHENEDISTRSEPGSQEHSGKHEGSNDGILGPSVSRRGGGDEQLSGSSDSDEEQDDEQRAGDEDPGYANANKRHVPTPAQRIIVQTNSEVDLLDDGYRWRKYGQKVVKGNPYPRSYYRCTYQGCDVKKHIERSSQDPKAVITTYEGKHSHDVPAVRNGSHAAANANGSSSTSLPVPHRVHSSASSSRRAAELQSASSASSMLLKEENEIT

SEQ ID NO: 5156 - protein, 249 aa, Sorghum bicolor
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAALALRGRAACLNFADSARLLRVDPATLATPDDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 5157 - protein, 1382 aa, Musa acuminata
MDVPESDCGFVNESELLFHCNQCDRELVRKIAQLLLPGLATACVDNTTGLFKSAASVAVVTRKEMVDYLKQRSQMYVTEAVGQGDDIVNMVEEFSDEPTEIISGFVDDFASSKRNLFSRVSGWLSSESREDKIDDFVQEMETNVFWSIDRREAIAEILIRNVDLKRAFHCSKKFDSAQQLAEHETQCSFRILGCTNEGCKAKFSAIHAEKHDSECPFKVIPCEQKCSERIVRHDMDRHCITICPMKLVNCPFYQVGCHSAFPLCNLEKHCSECLRSHLLYVLQVLHKQEASVEELRRRVQLLEKSHTLSELSEALDVRSLTLVIKEQEAKMKKLERDLKLFVSVAPSFAAAFPVDYDKSSERKVPDGIRSKDLLFSWRNGLRAELGFWRRFGSVALREMRLQRFGTSMDMGPGTDGFATADCGWSGSPIPCDPFALSELVNFDDYIESCSPATIVDQIFTMSFSIVQQTPGVWASPAQDIIAGDTSVAAGTYYSCGEKMASQKANLLLELPSHRPGMDIASRKIGCFDFDDISNEGNSTVPRPFGGVSLPDRMLRALSLLKESSCGGAILAQVWMPIRQGNHYVLSTSEQPFLCDQNLAGYREVSRHFTFSTKDAPGLFLELPGRVFISGRPEWTSNVIYYNRFEYLRVDYAVIHDVRGSLAVPIFDPDGCSCHAVLELVTTIEKPNFDTEMESVSKALQAVNLRSIKAQAHQQSFTKSQISIFSEIHDVSRVICHAHMLPLAITWIPIWCDDGAIYEAKFEKDDIGVMKPTSRRTILCIQKLACYVNDRQMKDFLHACAEHHLEKGQGVAGKALRSNYPFFSPDVRVYDIREYPLAHHARRFDLRAAVAFRLKSTYTGNDDYIVEFFLPINCRGSEEQQLLLSYLSSTMRRIHGSLRTVVDAEIGGSEIMRVGNHNEASLGSSSTAFSMKSSQLMDGNSETTAEMHFGVQNMESNEQSAGAHHEQLKSISMKHTEKKRSTAEKNISFSVLQHYFSGSLKDAANSIGDHFFEHVITVAVCPTTLKRACRQYGILRWPSRKIKKVNRSLQKIQKVIRSVQGVDGALKYDPSTRCLVASVSPPENPPLISSEPKGQDLMPASSSHHSETNHSIGKVEQDYFFHGRNLRGTMLKCETNKLGIPSNDCHRDFTSDGALLPYANMQGALSWPSYSKDASDSSYNSKEAVCQGSKDGLSFMTNECQIMSRNFSFVALHQMAMEVECNDGIIEHSHPSSGMTDSSNGRALNHPSFEKSKALISQIGPLITVKATYNGDTIRFKFLLSMGSHHLFEEIERRFKLLAGTFQLEHMDNDEEWVLLVNDSDLQECINVPNNIGSKTVKLQVRDVPCYIILVVGNQHRNLILRDAAVNPSDCGQVFVGCYVIVV

SEQ ID NO: 5158 - protein, 287 aa, Glycine max
MYLFLNPPVTLFSYFYLCCFHRIASYVGELSTKKMGRGRVQLKRIENKTSQQVTFFKRRSGLLKKASEISVLCDAQVALIIFSTKGKLFEYSSERSMEDLLERYERCSHTALAGANNVESPGFWSFEHIKLTAKVEVLERNIMNFFGNDLDPLSLKELHSLEQQIETSLKRIRTRKNQVMNQSVSDLHKKARTLQVQNRWLGKMKEKAKTVTEGPHNGPETLGFDSSTLNLSSPQLPPPPSPQRLVPSLTLSETMQGGTPVEETGEAQTVPSGNSLIPPWMLRCMSD

SEQ ID NO: 5159 - protein, 299 aa, Zea mays
MGAPKQRWTPEEEAALKAGVAKHGPGKWRTILRDSDFSALLRLRSNVDLKDKWRNLSVTAGGYGSREKARMALKKGRRVVPKLTAEPMDVDVKDMDDAHDTAIDVEPLAMAFESLPTEESPDKSVARLDDLILEAIRKLKEPSGPSKAAIAAYIEDQYWPPADFQRLLSTKLKALVNSGKLIKVNQKYRIAPSPPPSGRIGTKVSSAEGMKAENNNAKRLTKHQVIAELEKMKGMTKEEAAAFAAKAVAEAEVAIAEAEEAARVAEAAENDAEAAKAFLDAVTLSMRNRNAASMMLRAC

SEQ ID NO: 5160 - protein, 860 aa, Coccidioides immitis RS
MEYFDFDQAARDIDTASNCPEIDHQDFDALMNDDNVVVSATDALNDVAEGEKGWEPSFKLGGPWPMYRAPEPCFFCRSMGLDCFVAQRGVLQNRCTCCIALYRQCSFTNAEPQQKCLETLHVVGEDSYVPTGSLTGKRALKSYRGPSTGTLLEEPEQRGRKSGARFPKEAVRVLKSWLSEHTAHPYPTDEEKDALKAKTGLRRSQISNWLANARRRGKVRPSPRHPSPHPTGVPIPGKELPPGVDFADLNPLERWKHSPPENEAASARDIIQAMATAPFHPNGSNDTSGPVRSNSRRTGSSNGDSSFSNVRPAGSWSSYSLDTTQSSVSDMSFASVFSHRSSRASFGSMDTRERRRRRHKSAIGQNPFQKSRAARIYQCTFCTDSFATKYDWQRHEKSLHLALDKWTCAPQGGVILENGESVCAFCRYLNPDETHLESHNYTTCQEKSIQERTFYRKDHLNQHLRLMHNVKLGSWMDQWKSATTEVKSRCGFCSATFTTWKDRVDHLAAHFKAGAEMRQWKGDWGFESCIQRCVENSMPPYLIGEERNTLNPWVAQVPSLSAAKKPNASTAGTSAAQIPVPTDASCFKRLEVELSAYIGRLAAQGTVPTDAMIQAEARNTIYGSDDPWNQTCADNPTWLALLKRDTGIYDLPGTQNIQLDDLGMQPPFAANGGLRQAPKHSLRTTPPCSGSSGFQSPALPSSGFHSSGPSHRGSHAGSLAGSVDFSAGGLGQGSLGGLPSSTLGGTLSSSAPVSMDNDPFIQMGFDADFLQRLDDDYEDIGHDLDDLHLEKFGLGDSAGFHDLGFNDTTFNMTATSAPDQNPLASKLPTSMSYEARYQNVFDHSVAFSEPRASEFRDFGR

SEQ ID NO: 5161 - protein, 298 aa, Zea mays
  misc_feature (89)..(89): Xaa can be any naturally occurring amino acid
QASYKRRKLANRWWDEGRLGLPEPSLGKNQEEMAPSSKDGATEQPTSGGSGDDRENGTGEPKEGAVVTGNRRPRGRPPGSKNKPKPPIXSVTRDSPNALRSHVMEVAGGADVAESIAHFARRRQRGVCVLSGAGTVTDVALRQPTAPGAVVALRGRFEILSITGTFLPGPAPPGSTGLTVYLAGGQGQVVGGSVVGTLIAAGPVMVMASTFANATYERLPLDDAEEDPGQAQLPPGPGGGPPLIMGGIADPSAMPMFGGGGGGVPPSLMMPGGAAASGAGLQLGHEGLAWARARPPPY

SEQ ID NO: 5162 - protein, 242 aa, Ceratopteris richardii
  misc_feature (8)..(8): Xaa can be any naturally occurring amino acid
  misc_feature (11)..(11): Xaa can be any naturally occurring amino acid
  misc_feature (19)..(19): Xaa can be any naturally occurring amino acid
MLNYSFDXVKXISSSDLIXPAGNYYQHVTFNEQGDLADDDGICYDIINSTGEKKRGLTVDQVKYLEMNFTMDFKLEPERKALIAKELGLRPRQVAIWFQNRRARWKNKQLEQDYETLKSSYEALLQENEDMVKRNKALDEENKLLQAEIARLTGISGNVDVPVDIDAKVASPDLDSDSDLESTVKGEKQQNLKSEIGIPAKLDAQSEILESLTLSCLKSQEAIVAFVEQPIGANDSVVACAL

SEQ ID NO: 5163 - protein, 284 aa, Triticum aestivum
MAAAIDLSGEDLVRALEPFIREASAPLPLHSHLSPTSPFSFPHAAYSGYPYGVQAQAQTELSPAQMHYIQARLHLQRQTGQPGQLGPRSQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPAATTAADVPEMQQLDFSEAPWDEAACFALTKYPSYEIDWDSLLATN

SEQ ID NO: 5164 - protein, 256 aa, Ceratopteris richardii
MPFIPATMKHHAALDSTDIKGKSKNSCKDLKSRALKRSRQDVVVDSDTEEKRRGLTMEQINILEMKFKEDVELEPERKTLIAKQLGLRPRQVAIWFQNRRARWKNKQVECKYELLKAQYDAVVKEKESITMEHESILEGNRRLHSESIEKANTLGGAISPALPSCNIMSPTDSADCQSEIIMSVDVIEGAISCCHPIQEPSSRMAADVVVETEYSFYSSLDNSFSQFPMLVRQLIANGHCLQDAYDIYLGCEYFYG

SEQ ID NO: 5165 - protein, 192 aa, Ceratopteris richardii
MAWSVSVGSTSIPQDEDETKQSVITSGISKTKGHNQGHRKHPSKDVTKDIGDGDELMCGVEKKRRLTAEQVNFLETSFSMDLKLEPERKAHLAKQLGIQPRQVAIWFQNRRARWKNQQIEQDYESLKASYEAVVEEKERLLKEHDLALEANKRLQAEIARLTRSLQSYDRNGMSEPKGGTAEQWQIRGNVNQ

SEQ ID NO: 5166 - protein, 763 aa, Gibberella zeae PH-1
MSAPNPRKRAAPGASPIVPIPQQMQPQYNAGNGAGNQGPRWTGMDPSNYMNGVDGLMDDNKNSFGLVPAQQQYSQPVPTPSNTIARRQMNHALVPTNQRSFDGVVEPWGNFVGDENTLLQGNFENLNEQDNVEVLEERAQKAKRDAQAKRKQIPPFVQKLSSFLEERKNEDLIRWSEKGDSFIVLDEDEFAKTLIPELFKHNNYASFVRQLNMYGFHKRVGLSDNSMRASERKNKSPSEYSNPYFRRGHPNLLWLINKPKSGSKAKKGSKGAEGDNDSEDDVANEEVLTSGLGPTAAQPPRSLPAGESQPAPKKEMGLIREELSKVRDQQKLILGAINRLQRNNTELYNQALMFQTQHDRHQNSINAILNFLANVFRKTLEDQGNSQNVSDIISMITNQNQQSAQHGSVFELGDYIQQMNPNTYGTPKKTRGLLPAPQQNNRAQAVRSSSTPNRSTPGSTAYQPVSHHNHNPEMGHVTELVDNSPSDTTTPNLRQELEANPEERMMSLINEHNKHNNGHGMDIPDAADLVASAPNALSNAQRNNLANFIAGQTSAAPSGRSTPASTPVSATPIPTPTQIPTSNSHMAMPTMSTSASVSPPPASSVPPPSLSPIMGPPMVPPSINEINSNSMELNHLQRLQSQQDAKISEIGSMLGPLSPSGHVPGLSDDAAAYFDPQSTDFDQFFDIGDLSGGHDFTDGSDFDFAIDTDPNHQNQAPLHPGHVMSHTSLTNTPSPAGTEEISRDDLRLENNPSDRGTKRQRIA

SEQ ID NO: 5167 - protein, 271 aa, Silene latifolia
  misc_feature (92)..(92): Xaa can be any naturally occurring amino acid
KIMAHPHYPRLISAFVNCQKVGAPPEVVARLEEAEAMAMNQGGGGGGGYIGEDPGLDQFMEAYSEMLTKYEQELSKPFKEAMLFLSKIDCQXKALTLSSSLDSPSSDLVPGAHDDAGTGRNGSSEDEIDVNNNFIDPSAEDRELKGQLLRKYSGYLGSLRQEFLKKRKKGKLPKEARQQLLDWWTRHYKWPYPSESQKVALAEETGLDQKQINNWFINQRKRHWKPSEDMQFVVMDAAAAAAHSHGHPHYTYMDPATLANHFPMDVSSTLM

SEQ ID NO: 5168 - protein, 276 aa, Silene latifolia
  misc_feature (62)..(62): Xaa can be any naturally occurring amino acid
KIMAHPHYPRLLSAFVNCQKVGAPAEVVARLEEAEAAMTVSQGSRSGSGSGSGGQGYIIGEXPALDQFMEAYSEMLTKYEQELTKPFKEAMLFLSRIESQFKTLTLSSSSDSPSSGICGDIGERNGSSEEDIDVNNNLIDPCVEDRELKGQLLRKYSGYLGSLRQEFLKKRKKGKLPKEARQQLLDWWSRHYKWPYPSESQKLALAEETGLDQKQINNWFINQRKRHWKPSEDMQFVVMDAAAAHAHSHGHPHYGYMDNSLPNTFPMDVHVPPTLI

SEQ ID NO: 5169 - protein, 379 aa, Populus trichocarpa
MCGGAIISDFIAPTTTARSSRRLTSGFEWLELKKPFNNKHLKPVVADPEDDFEADFQEFKDESDVDEDYDVFADAKPFAFSASVSEPAQKRGLPRGSTAVKSAGFSGPAEKSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSFPAIGDSGVTPLTPDNASMYFNSDKGSNSFDCDFGWGEQGPEILSVLAATPEVDESVFVDANPKKLKSYSENEVPVEEKNGKSLSEELLAFDNQLMNLQMPDLVGNWEASLDSFLNGDTTQDGTNAVDLWSFEDFPSMVGGVY

SEQ ID NO: 5170 - protein, 482 aa, Glycine max
MTQFTPPLPPLHHQITSLLPNPNMMNKNQIPRPRPWPASGFPTTSKALSNLGNANCMEQLLVHCANAIETNDVTLAQQILWVLNNIAPHDGDSNQRLASGFLRALTARAAKTGTCKMLVSAGTNLSIDTHRFNIIELANFVDLTPWHRFGFTAANAAVLEATEGFSVVHIVDLSLTHCMQIPTLVDAIASRQHHDAPPPIIKLTVADACCRDHIPPMLDLSYEELGAKLVSFARSRNVIMEFRVVSSSYQDGFASLIEHLRVQQEQQQQQQQQHFVYAAEPSTPSEALVINCHMMLHYIPDETLSDTTDLTSYVYDSSSSAAVSVTPTSSLRSLFLKSLRGLDPTVVILVDEDADLTSNNLVCRLRSAFNFLWIPYDTVDTFLPRGSKQRQWYEADICWKIENVIAHEGLQRVERVEPKNKWEERMKNASFQGVGFSEDSVAEVKAMLDEHAAGWGLKKEDEHIVLTWKGHNVVFASAWLPA

SEQ ID NO: 5171 - protein, 956 aa, Arabidopsis thaliana
  misc_feature (935)..(935): Xaa can be any naturally occurring amino acid
MEAESSTPQERIPKLRHGRTSGPARRSTRGQWTAEEDEILRKAVHSFKGKNWKKIAEYFKDRTDVQCLHRWQKVLNPELVKGPWTKEEDEMIVQLIEKYGPKKWSTIARFLPGRIGKQCRERWHNHLNPAINKEAWTQEEELLLIRAHQIYGNRWAELTKFLPGRSDNGIKNHWHSSVKKKLDSYMSSGLLDQYQAMPLAPYERSSTLQSTFMQSNIDGNGCLNGQAENEIDSRQNSSMVGCSLSARDFQNGTINIGHDFHPCGNSQENEQTAYHSEQFYYPELEDISVSISEVSYDMEDCSQFPDHNVSTSPSQDYQFDFQELSDISLEMRHNMSEIPMPYTKESKESTLGAPNSTLNIDVATYTNSANVLTPETECCRVLFPDQESEGHSVSRSLTQEPNEFNQVDRRDPILYSSASDRQISEATKSPTQSSSSRFTATAASGKGTLRPAPLIISPDKYSKKSSGLICHPFEVEPKCTTNGNGSFICIGDPSSSTCVDEGTNNSSEEDQSYHVNDPKKLVPVNDFASLAEDRPHSLPKHEPNMTNEQHHEDMGASSSLGFPSFDLPVFNCDLLQSKNDPLHDYSPLGIRKLLMSTMTCMSPLRLWESPTGKKTLVGAQSILRKRTRDLLTPLSEKRSDKKLEIDIAASLAKDFSRLDVMFDETENRQSNFGNSTGVIHGDRENHFHILNGDGEEWSGKPSSLFSHRMPEETMHIRKSLEKVDQICMEANVREKDDSEQDVENVEFFSGILSEHNTGKPVLSTPGQSVTKAEKAQVSTPRNQLQRTLMATSNKEHHSPSSVCLVINSPSRARNKEGHLVDNGTSNENFSIFCGTPFRRGLESPSAWKSPFYINSLLPSPRFDTDLTIEDMGYIFSPGERSYESIGVMTQINEHTSAFAAFADAMEVSISPTNDDARQKKELDKENNDPLLAERXCWTSTIASLQSKQQKKSHPTS

SEQ ID NO: 5172 - protein, 216 aa, Gossypium hirsutum
MDFVVQDYDMVDFGSVSESGTDRPVNFSDDYMMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMQKGFYLDEEALFGTQRFWANMAAGMMMSPPRSGHDGGWEEHEVDDYVPLWSYSI

SEQ ID NO: 5173 - protein, 244 aa, Triticum aestivum
MDSMESCVPPGFRFHPTDEELVGYYLRKKVASQKIDLDVIRDIDLYRIEPWDLTEHCGIGYEEQNEWYFFSFKDRKYPTGTRTNRATMAGFWKATGRDKAVHERSRLIGMRKTLVFYKGRAPNGQKTDWIMHEYRLETDENAPPQEEGWVVCRAFKKRTAYPNRGMMERWGSNYSYNEVNAMSGAPFPDPNMASTYAAAAQMGRGASFKEEAEQLDGAAALLRYTSSHLVELPQLESPVAPLPR

SEQ ID NO: 5174 - protein, 186 aa, Lupinus multiflorus
SGPYPYFPSSSSSYHPFAFFNPENASSNNTFSHDLLSFPYNTPTTHHYHAPIPETLSNFADCAASTAMFKNDVSGSNFGFSNFLAKKPASKKDRHSKIHTSQGLRDRRVRLSIEIARKFFDLQDMLGFDKASNTLEWLFNKSKKAMKELARSKNSSSGVVANSFSSSDSECEVVSMINQDSIDATP

SEQ ID NO: 5175 - protein, 613 aa, Aspergillus nidulans FGSC A4
MSADEQVAKEEVFQKPGDLVERNEETGVMQVESLCMNCHENGITRLLLLRVPFFRDIILESFECEHCHFKDNSVKSAGQIQEKGSVYTLDVENEEDMQRQVIRSDVSIFKVESLGIEMPKGESQLTTVEGVIQKIHESLSSEQPLRKVQAPELHDALVPIIDKLQKILDREGYPFTVSLDDPTGNSWIAPTTHDTGHKYRRRDYARTHEQNEQLGIASDPEALKNEGKTIGNLDDVDIVDGKVYSLPADCPACAKECTVNMQKVDIPYFKEVFILSNVCEHCGYRSSDVKTGGEVPEKGKRITLSVETITDLHRDILKSDTCALHSEELEVTVQPGTLGGRFTTVEGLLTEIRDQLKGQIYDIDDSTQSGGDSMSATDKEKWARFFDRLDSAIKGDLKFSITLEDPMANSYVQDLCAPAADPQLKTEEYTRTEEEEEELGLKDMKVEGYEAEANEKDGEENKARTFPFCSISISCGNPITTSRLVASAIPIYPLTSPWDIPPPAAAITLRLTRSEVYDSMPSTVYLAGIAWLGLERATDPDFYRLELVPNKGAQAILGYNFNTKNRATDNPVGRELELQPAAAGVKGPTYLRMEAWNPASYLNGAGPARDARP

SEQ ID NO: 5176 - protein, 275 aa, Triticum monococcum
MEADASHAPTTSSSSVSSSTLSTSSSSSSLATSALELPKSPKPKHPKKRKRAASDREQDAAANTNGVRGDESSCCSTDEDNAAASVKAAVPKSGFKHPSYRGVRRRSWGKWVSEIREPRKKSRIWLGTFPTAEMAARAHDVAALAIKGRSAHLNFPELAHELPRPDSTSPADIQAAAAKAAATAAVQCEAEPEHEPETPSSSSGAASETPEPAPCAEAAPADSGEVDNALFDLPDLLLDLRDGLFWSPVWPAALAAEEYDGGCCVGLSEPLLWAE

SEQ ID NO: 5177 - protein, 297 aa, Vitis vinifera
MKRERDAEAELNLPPGFRFHPTDEELVVHYLCRKASYQTLPVPIIVEIDLYKYDPWQLPEKALFGIKEWYFFTPRDRKYPNGSRPNRAAGNGYWKATGADKPVRPTGSTKAVGIKKALVFYSGKAPKGTKTDWIMHEYRLAQPNRSSDKKSSLRLDDWVLCRIYNKKNNWREKMQHQMNQLLPHEPIDPFEVAEDDGSDSLRTPESDIDIETLSYNHDLHGAQGQGYSYQVLHDNNLQITDTDSGFPARECFKEEDDYWLTNLNLEDLQNSLTTFGTMPLPDFSYQDSFSMIHGLPY

SEQ ID NO: 5178 - protein, 452 aa, Arabidopsis thaliana
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPVMTFPSTCGACTEPCETRMFKIEIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 5179 - protein, 335 aa, Triticum aestivum
  misc_feature (38)..(38): Xaa can be any naturally occurring amino acid
  misc_feature (67)..(67): Xaa can be any naturally occurring amino acid
DRKKKRKAEDGEGCRTCSCKKSRCLKLYCVCFASGSQXPELCGCDPCYNKPIHGVQQNTPPGLPLQXVVRPAEAGQNSTEFARYQMDFFRRKCTCKKSGCLKKYCDCYQGGAGCSINCKCDDCKNPYGKKVGVILDGKSILATPTPGPTPIERNGTEVISSDDDDDDEDDYYMNRPLSPIPPSPVSRESSFQQETLVGVEVHTVNGHLYPKPLTQVRPETWQLSRRPAEEARGEQWRYMRRPSEDGTSDAMEGHADPKFHHQRDNNNSKQRESPADNRFSIPRCIEVMNGMADLSPVDKSLAPDVFLDPSNREIFLSLSVDIRTMWLKRKMRSLV

SEQ ID NO: 5180 - protein, 92 aa, Kluyveromyces lactis
  misc_feature (12)..(12): Xaa can be any naturally occurring amino acid
  misc_feature (62)..(62): Xaa can be any naturally occurring amino acid
  misc_feature (76)..(76): Xaa can be any naturally occurring amino acid
ARPAFVNKLWSXVNDKSNEKFIHWSTSGESIVVPNRERFVQEVLPKYFKHSNFASFVRQLNXYGWHKVQDVKSGSXLSNNDSRWEFENERHA

SEQ ID NO: 5181 - protein, 200 aa, Rosa chinensis
MLCDASASSPMAYREEPAAPSSPASLLMNLGQTLTHIQSGVTKKRKAGRKKFRETRHPVYKGVRQRNGKWVCEMRQPGLKKSRVWLGTFTCPEMAARAYDVAALALKGESAQLNFPDEAKASPSWTSSMSLPELTSMVNLEKVEVGSSKGYVDEEELFNMPEILDSMAEGLILTPPALKKGFNWDDYDLENAVEFSLWSD

SEQ ID NO: 5182 - protein, 75 aa, Zea mays
  misc_feature (24)..(24): Xaa can be any naturally occurring amino acid
  misc_feature (30)..(30): Xaa can be any naturally occurring amino acid
  misc_feature (63)..(63): Xaa can be any naturally occurring amino acid
FNANGPEIGFDCFLSASHFVVEDXSLLENXLKFRRFESSFPSQLPECVFQKMEFPFDVFKFAXTGHLTTAPFGLV

SEQ ID NO: 5183 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQKVLCTKDRQFMQQISDLQQKGTQLAEENMRLKNQMHEVPTVSTVAVAEAENVVPEDAHSSDSVMTAVHSGSSQDNDDGSDISLKLALPWK

SEQ ID NO: 5184 - protein, 472 aa, Hordeum vulgare subsp. vulgare
MTYGGERRGSNPTTVIHKTFLPLPLFRVLETTSSSCSSPSFPRPYFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 5185 - protein, 291 aa, Oryza sativa Japonica Group
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 5186 - protein, 208 aa, Glycine max
MVLSINSGSLFIPTFTFDLILFPTFRTAATRYRERERERAKKKQTSTQQKEKEKPLKHAPLIPTSKKVLLFKNFLFTEEGSLHLHLQPSIMVKLEHKIKTEPSSKEMRLSSLSSSASTSSDCKKKKYKGVRMRSWGSWVSEIRAPNQKTRIWLGSYSTPEAAARAYDAALLCLKGSSANLNFPLSSSQQYIPGEAVMSPKSIQRVAAA

SEQ ID NO: 5187 - protein, 274 aa, Ceratopteris richardii
MAWSPVKEEHLPQLVSTESTIEKTLKAKDPCKRPKRRAKKRTGKGSTIDDSIDKRRGLTVEQINFLEMSFKEDNKLEPERKACIAKQLGVRPRQVAIWFQNRRVRWKNKQVEQDYETLKARYQDVVKEKDSIMMQYESTMEGNRKLQAEVARLTNLLQSTEGISAHTDMDQVLSNCNSENLNCISENISPAKSADYPSEIIVSGDPTEGDISRFIFQEPISSMPYDLLPDGDYFILSPENSTGSFPSLVQQLVSNGHCVEDAYNIYLGYEYLCC

SEQ ID NO: 5188 - protein, 92 aa, Kluyveromyces lactis
ARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 5189 - protein, 273 aa, Oryza sativa Japonica Group
MAGFGLDQHLDLIRAHLLEDAHHHVLAPSPSPSPPGTGRVRPAPVSLPPRPPLLWAAASAAPRQQEECFELGGGYAGEGEGEEEDDFRRYRGVRQRPWGKYAAEIRDPARKGARVWLGTYDTAVEAARAYDRAAFQLRGSKAILNFPNEVAADAAVKWAPPVAPIPAAAMSAGRGKRVRSEEQYYLREVKKERLIMAPPENSSSSSSSAAAAAGDIWDELKGICSLPPLSPLSPHPHMAFPQLFVIDLAFGQILNSFVLLLLRTRDFAFDYAI

SEQ ID NO: 5190 - protein, 227 aa, Ceratopteris richardii
RRSPPKEELDDDDLGDELSNPTEKNRRLTAEQVNFLEMSFNIDLKLEPERKALLAKKLGIRPRQVAIWFQNRRARWKNKQIEQDYESLKTKYEAVIKEREVILLQHEAAMQENKRLQAEVRRLMDLVEATGVGACDVTGVSEGKSELMSPSKSTGRSRVTCKTRVKCHSIAVSASGADVPMPRFELDYGFCRSNDMGVDLHECPTFSLWRIFLGLICPCLFVKFASK

SEQ ID NO: 5191 - protein, 369 aa, Triticum aestivum
  misc_feature (24)..(24): Xaa can be any naturally occurring amino acid
  misc_feature (37)..(37): Xaa can be any naturally occurring amino acid
  misc_feature (58)..(58): Xaa can be any naturally occurring amino acid
  misc_feature (215)..(216): Xaa can be any naturally occurring amino acid
  misc_feature (223)..(223): Xaa can be any naturally occurring amino acid
  misc_feature (285)..(286): Xaa can be any naturally occurring amino acid
  misc_feature (299)..(299): Xaa can be any naturally occurring amino acid
MTYGGERRASNPTTVIHKTFLPLXFRVLQTTSSCSSXPSPRSSFSPPVRSAACEDFCXAGAAIGIDPWMDAAQWHQGLGLVKPMEEMIMAGNPNPNPNPNGNPNPQPAPPSGAEAQRAPVPGPPAGGAGAAAGTGSTERKAARPQKEKAINCPRCNSTNTKFCYYNNYSLQQPRYFCKTCRRYWTEGGSLRNVPVGGGSRKNKRSSSSVVSSAAXXAVSTSAXASGTVPVGGMGAKNPKLMHEGAHDLNLAFPHPHGRVLHPSEFAAFPSLESSSVCNPGGAMAXXRAGGGRGMGPFSXMDLLRSTGCYVPMPQVQLGNAPEYAARGRAGEFRCRADQRTSQRSRDEPPAQGRGLTCWGLLNGEVEPGE

SEQ ID NO: 5192 - protein, 242 aa, Akebia trifoliata
MGRGRVQLKRIENKINRQVTFSKRRSGLLKKAYEISVLCDVEVACIVFSDKGRLYEFSTESRMERILERYERCSLAAEEIATIDPQSQGSLPLESRRLKARLDVLQKTQRRFMGEDLDSMSIKEIQNLEQQLDASLKQIRLRKNQLMYESICELQKKETALQEQNNQLGKKIKEKEKTLTQQVNWEQPNQGQNSPAFLQSQTLVSLNIGGPYQARSGEEEERVQSHTQPSTVLPPWMLGHVN

SEQ ID NO: 5193 - protein, 194 aa, Ceratopteris richardii
NQGHRKHPSKDVTKDIGDGDELMCGVEKKRRLTAEQVNFLETSFSMDLKLEPERKAHLAKQLGIQPRQVAIWFQNRRARWKNQQIEQDYESLKASYEAVVEEKERLLKEHDLALEANKRLQAEVCFKHAMSLLWSGYEESHVNIYSMTDSITNAYFHCLTRRHSSLILLHFSSQHTLIGFGGICDAWSPTFRYI

SEQ ID NO: 5194 - protein, 348 aa, Glycine max
  misc_feature (240)..(240): Xaa can be any naturally occurring amino acid
SVCPTTLKRTRIQHGIPRWPSRKINKVNRSLKKIQTVLDSVQGMEGGLKFDPSMGAFVAGGSIIQEIDAPKSTIKDPVPVTQDAFSVPPAPCSEGENFSIKLEGKLKKTNVSSVDYSEDSKSMAINDGSCQMASLCTKVQDCPEQACLGSVLAKEHDKRILNKGGLSVEKFKHNIVGQSSKSLIVDEMDIGVDGDDGVVERNHPTSSSLTDSSNGSGSMMHSSSSGSRSFENQDQSKVKXTIIDCGSKLIVKATYREDTIRFKFDPSEGCFRLYEEVAARFKLQNGLFQLKYLDDEEEWVMLVNDADLQECIEILDDIGTRSVRFLVRDMPSVLSSSGSSNSYLGGSS

SEQ ID NO: 5195 - protein, 353 aa, Petroselinum crispum
MEEIVSLIYNGCRLARDLEVNLPNLANRPEILWNNCDEIVRIFTDTRDRINAQFGGGNIQSENVGGAMQQWLQLVQQQEGGSEGAVMAPSETERWTAGGRGDQLQPLDAAGSAARGATFQRMRRRKDDADKRSVRVPAPQMGNTEIPPEDGFTWRKYGQKEILGSRFPRGYYRCTHQKLYQCPAKKQVQRLDDDPFTFEVIYRGEHTCTGSSTAPSMSALPENTEASRVMFQQAAATMSSTQLLHSSSTTTSLPGSHWLSIRTQAADVDTTNTNNPFVNMHMFSNITGRVDSSSGNVAGPSTARDSGDQYYEPLAEFVDVMFNSGSSSNSNMDLIFTTALEDQKWDGGENKQD

SEQ ID NO: 5196 - protein, 254 aa, Brassica rapa subsp. chinensis
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELLERNQRHYLGEDLESISIKELQNLEQQLDTSLKHIRSRKNQLMHESLNHLQRKEKEILEENSMLTKQIKERESILRTHQNQSEQQNRSHHVAPQPQPQLNPYMISHQASPFLNMGGMYQGEDPTAVRRNRLDLTLEPIYNCNLGYFAA

SEQ ID NO: 5197 - protein, 316 aa, Arabidopsis thaliana
MEQGDHQQHKKEEEALPPGFRFHPTDEELISYYLVNKIADQNFTGKAIADVDLNKSEPWELPEKAKMGGKEWYFFSLRDRKYPTGVRTNRATNTGYWKTTGKDKEIFNSTTSELVGMKKTLVFYRGRAPRGEKTCWVMHEYRLHSKSSYRTSKQDEWVVCRVFKKTEATKKYISTSSSSTSHHHNNHTRASILSTNNNNPNYSSDLLQLPPHLQPHPSLNINQSLMANAVHLAELSRVFRASTSTTMDSSHQQLMNYTHMPVSGLNLNLGGALVQPPPVVSLEDVAAVSASYNGENGFGNVEMSQCMDLDGYWPSY

SEQ ID NO: 5198 - protein, 95 aa, Brassica rapa subsp. narinosa
MGRGRVEMKRIENKINRQVTFSKRRAGLLKKAHEISILCDAEVSLIVFSHKGKLFEYSSESCMEKVLERYERYSYAEKQLKAPDSHVNAQTNWSM

SEQ ID NO: 5199 - protein, 446 aa, Arabidopsis thaliana
MMMPDDHHPLSFPSYVLHQEHIAPNPNPNPNPTSSNSAKRKRNLPGNPDPDAEVIALSPNSLMTTNRFICEVCNKGFKRDQNLQLHRRGHNLPWKLKQRTNKEQVKKKVYICPEKTCVHHDPARALGDLTGIKKHFSRKHGEKKWKCDKCSKKYAVMSDWKAHSKICGTKEYRCDCGTLFSRKDSFITHRAFCDALAEESARFVSVPPAPAYLNNALDVEVNHGNINQNHQQRQLNTTSSQLDQPGFNTNRNNIAFLGQTLPTNVFASSSSPSPRSASDSLQNLWHLQGQSSHQWLLNENNNNNNNILQRGISKNQEEHEMKNVISNGSLFSSEARNNTNNYNQNGGQIASMSATALLQKAAQMGSKRSSSSSSNSKTFGLMTSIFNNKQAENIKTKEVDERGFTRDFLGVGSQHRSWPLLMVNHNLPDSSPPASTDGTPTADMNQ

SEQ ID NO: 5200 - protein, 99 aa, Saccharomyces cerevisiae
MAATKEAKQPKEPKKRTTRRKKDPNAPKRGLSAYMFFANENRDIVRSENPDVTFGQVGRILGERWKALTAEEKQPYESKAQADKKRYESEKELYNATRA

SEQ ID NO: 5201 - protein, 288 aa, Zea mays
MSSAEDGYCSSDSPRAESPDEPQAGADAESPRAGAGLNKRERDLPASPSSPLPPAKRSRRSVEKRVVSVPLAECGDRPRGASGEGPPPSDSWAWRKYGQKPIKGSPYPRGYYRCSSSKGCPARKQVERSHADPTALLVTYTFEHNHEAPQPKTSGGSCCHQQGKPSAPKPDEPVAEQEDELGPEHEPEDEQEPEQKVVPGLAGPETAPATATLAPVAEEDESFDLGWFDQYPTWHRSALYAPLLPPEEWERELQGEDALFAGLGELPECAVVFGRRRELSLAATAPCS

SEQ ID NO: 5202 - protein, 260 aa, Vitis vinifera
MKGRVCELCNEEASLYCGSDSAFLCWSCDARVHGANFLVARHVRHTLCSECNGLAGDTFFGVGFQPHRLICRSCSSEVESETSTDHDSKSSSSPCVSTTESAPRKGGVSRRKAERTGFTSSVSAVSGVDSRFPSKLRARSSVDAKAEDILVNWCRKLGLNGSCTSVASHALGVCLVKLTVLPLRVSLVAAISCAAKLSGDRSAYTPQNLKRLVEISGVPAKLILAAESKLARVLKMERRRPRHVRDREEGWAECSGEEFR

SEQ ID NO: 5203 - protein, 269 aa, Zea mays
MAPSSKDGATATEQPTSGDDDRENGGTGEPKEGAVVAGNRRPRGRPPGSKNKPKPPIFVTRDSPNALRSHVMEVAGGADVAESIAHFARRRQRGVCVLSGAGTVADVALRQPAAPGAVVALRGRFEILSLTGTFLPGPAPPGSTGLTVYLAGGQGQVVGGSVVGTLTAAGPVMVMASTFANATYERLPLDDADEEPAGQQAAQLPPGPGGGQPMVMGGMADPSAVPMFGGAGGVPPSLMPAGAAAASSGAGLQLGHDRLAWAHARPPPY

SEQ ID NO: 5204 - protein, 314 aa, Gossypium hirsutum
MEGGGSDDHHHHHHSHHHHHQQPLHHHHHHHHRPTFPFQLLEKKEEDNQPCSSSSSLPFPSLPVSSSSADQHTSTRSISTHQISPETSKTPPPKRTSTKDRHTKVDGRGRRIRMPALCAARVFQLTRELGHKYNGETIEWLLQQAEPAVIAATGTGTIPANFTSLNISLRSSGSSMSVPSQLRSSGFSSNFSMQQRRSLFPGIGLETTPTPTTFLNFQSSSTSLGISEEAEESSLGRKRRPEQDLSSQHHQNGELLVASSTVHSGESPRSSSGNFWMVTNSNNQAMSGGDPIWTFLQLITVVCIGELCLVGCIS

SEQ ID NO: 5205 - protein, 400 aa, Brassica rapa
MWDLNDSPHQTLVEEESEELCYSSPGKRVGSFSNSSSSAVVIEDGSDDDEPNRVRPNNPLVTHQFFPEMETSVGDDGGGGPGSGFPRSHWFGVKFCQSDLATGSSAGKPATVAAVVEPAQPLKKSRRGPRSRSSQYRGVTFYRRTGRWESHMWDCGKQVYLGGFDTAHAAARAYDRAAIKFRGVEADINFTIEDYDDDLKQICYCNLSFDALTFHIRYVYLGLFDTEVEAARAYDKAAIKCNGKDAVTNFDPSIYDDELNAESSGNPIQHDHNLDLSLGNSVNSKQKGQDMRLKMNQQDSLHPNEILGLGQTGMVNHIPNSNLQFPGSSNIGGGGGFSLFPVAENHRFDGRTTTNQVLANAAASSGFSPHHHNQIFNSTSTSHQNWLQTNGFQPSLMRPS

SEQ ID NO: 5206 - protein, 263 aa, Triticum aestivum
  misc_feature (77)..(77): Xaa can be any naturally occurring amino acid
  misc_feature (134)..(134): Xaa can be any naturally occurring amino acid
MSSSAMEALHALIPEQHQRDVEAAAALSGATSGEESGHVLQGWAKRKRSRRQRSEEENLALCLLMLSRGGKQRVQAXPQPEAFAAPVPAEFKCSVCGKSFSSYQALGGHKTSHRVKQPSPPADAAAAPLVALPXAVAAVLPSAEPATSSTAASSDGTTNRVHRCSICQKEFPTGQALGGHKRKHYDGGVGAAASSTELLAAAAAESEVGSTGYGSSAARAFDLNIPAVPEFVWRPCAKGKMMWEDDEEVQSPLAFKKPRLLTA

SEQ ID NO: 5207 - protein, 322 aa, Arabidopsis thaliana
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 5208 - protein, 281 aa, Petunia x hybrida
MRTPSSSSTTSNKVTPCCSKVGLKRGPWTPEEDEILTNYINKEGEGRWRTLPKKAGLLRCGKSCRLRWMNYLRPSVKRGHIAPDEEDLILRLHRLLGNRWSLIAGRIPGRTDNEIKNYWNTHLSKKLISHGIDPRTHKPLKNSNSSSDDITNKLASSSPPSSSKANDLNPILSPTYISSFQMEEPLGKINTHPGEITSLDDQYQSNAILAEYGDDLNIAVTIEEDVEMNCCTDDVFSSFLNSLINEDMFACQNQQTNGTFQDFDPFMASSSTPSSDQYNPS

SEQ ID NO: 5209 - protein, 170 aa, Picea sitchensis
MAREKIEIKRRDNTSTRQVTFWKRRKGLFKKARELSILCEADVALVVFSSTGKLYDYSSSSMEVILDKYVLYPSTIQKDGQQILEFESQDPKRIKQQFEDASQDLREELEGLTLKDLEKLEEQFEMELSCIRSQKVEHLVKKINELQQKVIQMIEENTKLRGQLNEGDGE

SEQ ID NO: 5210 - protein, 118 aa, Aquilegia alpina
TAQGTRDRRMRLSLEIARKFFDLQDMLGFDKASKTVEWLLGKSEEAINELHKGCTGETKSTVSSTSECDVVSEIDEGQKGLTKIDEKQSIDGIVLREKTTTKMLSRTTCHILAKDSRA

SEQ ID NO: 5211 - protein, 1196 aa, Oryza sativa
MSSQSVVAVKQITAPDKIVETCPSTKHSAHKLFDVKPDFQGLIDDNLSSSSQSSSIKIELIRSSSLPNILPFQKRSSEPEPESPLSHVSHPNVSEPVYSNSSTFCASLFSSSSMETEPCRQLGTLPFLPHPPKCEQQVSAGHSSSSSLLVPGGDGDIGNAHDEPEQSDDLKDFLNLSGGDASDGSFHGENNAMAFAEQMEFQFLSEQLGIAITDNEESPRLDDIYGTPPQLSSLPVSSCSNQSVQKAGSPVKVQLSSPRSSSGSATTNKARLRWTLELHERFVEAVNKLDGPEKATPKGVLKLMKVEGLTIYHVKSHLQKYRLAKYLPETKEDKKASSEDKKSQSGSSGNDSVKKKNLQVAEALRMQMEVQKQLHEQLEVQRQLQLRIEEHARYLQRILEEQHKVSISSNSLSLKPPAESQPESPKPTSEKKEAESEAGAATSAQPSSEDKSPDAECKSSPPVCTTQDTQRRRLEKEKHGKTVDKETQKVSCNYCGKVVRTYNRLEHHLAGIRGNVYPCSLVPDSVRQSIKSSLEARKKDWIARKIGKHKSSELPPVRNLSLTSAHACRPLLQPITSGTDQEGSVSWHRCFVHFTNNLVQPGETTQVNAHDVSCNASSSQKGGQTIEVTRPPYQNPCMMNKPPEISSGQRIDPLSFSMENSSSQMQDSESSKEPTNDYLNSQARKSIGKLIFEAGLEPGILHLPSFKDMVDVLAWAQVAIPTYESIMEEQLREIQCHARDLKKHWEMNGCSVILDTWESRCGKSFISVLVHCSKGMLFIKSMDVSDIIDDVDELAVMLFRVVEEVGVLNIVQVITNDESPYMQAAEHAVLKRYGYSFFFTLCADHCINLLLENIAALDHVNEVLIKAREITRFIYSHAVPMELKGKYIQGGEILSSSNLKFVAMFITLGKLVSERINLVEMFSSPEWASSDLASRSSFRHVYEVVKTDNAFWSAAADILKLTDPLITVLYKLEADNCPIGILYDAMDCAKEDIKCNLRDKHGDYWPMVDEIWDHYLHTPVHAAGYILNPRIFYTERFSYDTEIKSGTNACVTRLAKNHYDPKKVAIQMDRYRRKSAPFDSDSAIQQTMEIPQVRWWSAHGTDTPELQTFAIRILSQTCFGASIYNIDRSISEQLHVVKRTYPEQERFRTMEYLHYNLRLAHCEPCVRGASGAQQHSRLTSQLGDWISSGQTTSYYK

SEQ ID NO: 5212 - protein, 546 aa, Nicotiana tabacum
MDPSMDLPTTTESPTFNSAQVVNHAPTPTPPQPPPPAPSFSPTHPPYAEMITAAITALKERDGSSRIAIAKYIDRVYTNLPPNHSALLTHHLKRLKNSGYLAMVKHSYMLAGPPGSAPPPPSADADSNGVGTDVSSLSKRKPGRPPKLKPEAQPHAQPQVQAQVQFQDQFQAQLQAQLQAQLQAQQQQAAQFQPQFQLIQQQPQYLPQQQFQPDPLLQPQQQFQTQPQTQAYATPEGHNYAGLGAESVFVSLGLADGPVGVQNPAVGLAPAPGAEESTAKRRPGRPRKDGSTVVKPVEPKLPDQSGGSKRRPGRPPKSVTVNAAPGSAMGSGRRGRPRKNSVPGRRGRPRKNAAVAAANGGANVANIPSVGANVTNVPAGGVPGAITTPKRRGRPPRSSGPPAATVGVTDVPIAAAFDTENLPNAVGGGGVTNNGALPPLGKRRGRPPKSYGAAAAAPTVKRPRKLSGKPLGRPRKNVTSPAVSDPKLVVAYEELKGKLEHMQSRIKEAANALKPCLNAESPAIALAALQELEELAAAGGNPVQQN

SEQ ID NO: 5213 - protein, 337 aa, Brassica oleracea
MGRSPCCDQDKGVKKGPWMPEEDYKLVAYIDKNGYGKWRSLPNIAGLNRCGKSCRLRWMNYLRPDIRRGEFTEEEESTVVKLHALLGNKWSKIASHLPGRTDNEIKNYWNTHMRKKMLQMGIDPITHEPKTNDLSPILDVSQMLAAAIGNGQFGNNTLFNNNIAVEDLLKLQLIHKMLQIITPKAMPNTNSFNTNSLDTKPVANNIKTNPVNPKPEQAAGQLNAIDPHVFTSQIENEDFMPSFEDAWDCFGDNQLPGLVMVSQENLNYQTGAGMMPDYYGDQLREVPSTGSISVTPETSGLNYPGTTQHSSGSNVQEDWEKFLDDETSDSCWKSFLE

SEQ ID NO: 5214 - protein, 293 aa, Brassica oleracea
MAGLDLGTSFRYVNHQLLRPDLHLHHNSSSGDVTPGVGIGHFTADDEDNNHQGLDLASGGGGSGSSGGGGHGGGGGGDGVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFVAGGQGQVIGGSVVGELTAAGPVIVIAASFTNVAYERLPLEEDEQQHLGGGGGANGGGNLFPEVAGGGGGGLPFFNLPMNMQPNVQLPVEGWPGNSGGRGPF

SEQ ID NO: 5215 - protein, 310 aa, Vitis vinifera
MDDLYRLQHEGISISGANAAAATIDFRRSVENSNVYRFESVETEAGMSDLIKSQIVNHPRYPNLVSAYIECRKVGAPPEMASLLEEIGRESQPMNSRSGEIGADPELDEFMESYCEVLHRYKEELSKPFDEATSFLSDIESQLSNLCKGALTAGTSGSYYSDEAAGTSEEELSCGEAEVSESQESLGARPGDQELKEMLMRKYSGYLSSLRKEFLKKRKKGKLPKDARTMLLEWWNTHYRWPYPTEDEKLKLSEVTGLDQKQINNWFINQRKRHWKPSEDMRFALIDGVSGNMGGGPVFLDTRGGTGSNI

SEQ ID NO: 5216 - protein, 205 aa, Oryza sativa Japonica Group
MASTSGSAAAVEERGNSERKRKRGATGESEGSEAQPSKWRTRRAHEIYSSKLLDAIRLVRSGSPSSSAAAPPRSRAVREAADRALAVSARGRTRWSRAILASHRRRIQAARRARLREAISPPSRHPSSSSGKGPKAPALARKAKVLGRLVPGCRKLPFPALLAEASDYIAALEMQVRAMTALAEVLSTVSGSGSASSSGGSSSPA

SEQ ID NO: 5217 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMMTSLEADSSHFSGGNEAEAIKAKILAHPQYPSLLGAYIDCQKIGAPPEVVARLDALTNEYENQQHRTTVSIGMDPELDQFMEAYCEMLTKYHEEL

SEQ ID NO: 5218 - protein, 319 aa, Physcomitrella patens subsp. patens
MRILCGGCDKNPASVMCCADEVALCTECDARAHAANKHANKRARVALRPAPEPTKCDICQEKQGFFFCLEDRALLCRDCDVSIHTANTLSGNHKRFLVPGTRVALEDLKDEPVEPITPGFCSLLATPRLLFRDPATSASSHPVSNPRGAYTARLRCTLSLLNWFHQPTQETERRKFAGCMRRSSVSEFLTDAVPGWRVDELLNLADCSEQFNTTDFSSSKVEGVTAVGGNYDWTADLSLFEEQMFSMHEVPEFPPPPPTLVAPPRLIRAPRQLARSSRSRQDAYLQDAFVVPDVGTPSAPASSASLPKRFKRDHHHMSN

SEQ ID NO: 5219 - protein, 108 aa, Brassica napus
GGGGGSFQEQQQVISRPASSSLSSTVKSCSGPRAAAKATKRYHPRTPPVAPEDCHSDCDSSSSVIDDGDDIASSSSRRKAPFMFDLNFPPLDGADLFADDLHCTDLRL

SEQ ID NO: 5220 - protein, 236 aa, Prunus avium
MVKMMRKKIKIKKIDCLPARQVTFSKRRRGIFKKAAELSVLCESKVAVVIFSATGKLFDYSSSSTKDVIERYKAHTNGVEKSDEPSVELQLENENHIGLSKELEEKSHQLRQMKAEDLEELNFDELQKLEQLVDASLGRVIETKEELRMSEIMALERKGAELVEANNQLRQTMVMLSGGNTGPELMEPERLNNYTGGGGEEEGMSTESAISTTCNSAHSLGDDSDNVTLSLKLGLP

SEQ ID NO: 5221 - protein, 316 aa, Oryza sativa Japonica Group
MAAGEEVMDRSTSAEDGYCSAGTDSPRAESVDEQGAAEESSPRGGQKRELPSPSASPSSPLPPAAKRSRRSVEKRVVSVPIAECGDRPKGAGEGPPPSDSWAWRKYGQKPIKGSPYPRGYYRCSSSKGCPARKQVERSRADPTVLLVTYSFEHNHPWPQPKSSSCHASKSSPRSTAPKPEPVADGQHPEPAENESSASAELEVPEPEPEQESEPVVKQEEEQKEEQKAVVEPAAVTTTVAPAPAVEEEDENFDFGWIDQYHPTWHRSYAPLLPPEEWERELQGDDALFAGLGELPECAVVFGRRRELGLAATAPCS

SEQ ID NO: 5222 - protein, 55 aa, Physcomitrella patens subsp. patens
QWRTGPMGPKTLCNACGVRYKSGRLLPEYRPAGSPTYVASKHSHSHKKVLEMRRE

SEQ ID NO: 5223 - protein, 824 aa, Oryza sativa Indica Group
MDTPDRAAAAARAEVRRTVCEGLSIIVNISESMKSRRTSCEGFKDSPLFSFIDSLSPIEPLKSAYSASSIQAYQSLNITSISSIFTSPHDNAQKESKLSKSSFAEFSESEVCADESDKNKPSKSSNAVRLFACTSTLTQATHKITSSVSEGTVGPPEGSNDLPQPGQFDSGSPDHNTTPCHGVRSDLKQGKCRKLQAFQTAKTNTSEKRKCLFSTEVQLMDGCQPEKLNDEILGCDWDDLISATSGELIAYDEDHKGVQLAVSNAESCGFLLSKLTGDGDISDRTHPSSSTQTYYRELLMDEDQTENAQLVPDGEKNISTEEIQDNLYEANGSIPTGYKVETQQQRGMRRRCLVFEAAGYSNRIVQKESVMDLSVSTCKGKSPVQNHSNPGKTPSPRVLRGIGLHLNALALTSKDKMICQDPMSSLVPSSATQQEAHGKMLSAGENFIHPGGELLELQMDDDCSAGVFLGNDHDSSQSNSPQKKRRKSDNGDDGEACKRCSCKKSKCLKLYCECFAAGVYCSEPCSCQGCLNKPIHEEIVLSTRKQIEFRNPLAFAPKVIRMSDAGQDITGEDPNNTPASARHKRGCNCKKSSCLKKYCECYQGGVGCSSNCRCEGCKNTFGKRDAAVSTEAEEMKQGGEEAENCGKEKENDLQKANAQSEDHPFLELVPITPPFDVSSSLLKPPNFSSAKPPRPTKARSNSSRSSSKAPGAVHSQKFSKIANSGLNEEMPDILRDDASPGNCVKTSSPNGKRVSPPHNALSVSPSRKGGRKLILKSIPSFPSLIGDASSGSSMNSSESAFNTASPLALASYSYACPWNQPGPS

SEQ ID NO: 5224 - protein, 899 aa, Burkholderia pseudomallei K96243
MFLGKWKREDCMPNHFSNGRTNQSRTVVIRSGAMPRLLGQPALEFLSLRGEEHLGKLYTYELLLRTPDDFHVPLATSANLDLKAMIGTEMTVCIQLDGIGTGAQGGVGAGAREISGLVVKAGFLRCEGRYNVYRIELRPWLWLATLTSDYKIFQDKSVVEIIDTVLHDYPYPVEKRLDIDKYSVAGESARNEPRAFQVQYGETDFDFVQRLMEEWGIYWFFEHSDNKHRLVLCDHIGGHRKAPSEAYHEIAHHPEGGKIDIEYINYFSTDEALRPGRVVIDDFDFTRPLASLVTSNHQPRETNWGEGELFEWPGDYTDSKHGDLISRVRMEERRATGSRAYGRGNVRGLACGHTFVLSKHKHDGANREYLVIESALMLTEVADETGSGYRYECDNELVVQPSNEVFRMPRETPKPTTSGPQSAIVVGPPGHEVWTDEFGRVKIRFLWDRYARNDATDSCWVRVSQAWAGVNFGGIYIPRIGQEVIVGFMNGDPDRPLILGSLYNTITPPPWDLPGDATKSGFKSKSITGGRENYNGIRFEDKLGAEEFHMQAEKDMNRLTKNDESHTVGANFSIGVGLTHTRAVGAMFSSIVGGAASYAVGGAESTMIGGAYALNVGGAHAVAVGGASSVSVGGAYARNVGGAYALTVGGVLSIVCGASSITMTACGSIKLVGKNIRIIGSDEVVVQGAPLQLNPGDSDCGGGGGGGGGGGAIPPIPLPSFFLDITKPILPPPPPPPTEVPPDPTPTPTPTPTPTPTPTPTPTPTPTPTPTPTPTPTPTPTPTPTPTPTPTPTPTPTPTPTPTPTPTPTPTPTPTPTPTPTPMPTPTPTPTPTPTPTPTPTPTPTPTPTPTPTPTPTPTPTPTPTPTPTPTPTPTPTPTPTPTPTPTPTPTPTPTSSEI

SEQ ID NO: 5225 - protein, 84 aa, Physcomitrella patens subsp. patens
KKGTVKLNKRVREPRYAIQTRSEVDVLEDGYKWRKYGQKAVKNSTHPRSYYRCTSHTCPVRKRIERKADDPGLVITTYEGTHNH

SEQ ID NO: 5226 - protein, 366 aa, Oryza sativa Indica Group
MEKVQASCEGDQGICKRGAKGGHPIDQNLVGGMTMSTGVPTTVPPTPALAALKNLLIRVVAAAAGKGLSSSAEEARCLWAKLPAPEEEEEAGQQPERPPSSYRRPPTSTLMAPVGLPPGFRFHPTDEELVNYYLKRKIHGLNIELDIIPEVDLYKCEPWELAEKSFLPSRDPEWYFFGPRDRKYPNGFRTNRATRAGYWKSTGKDRRVVHQHGGRAIGMKKTLVYYRGRAPQGVRTDWVMHEYRLDDKDCEDTMPIQDTYALCRVFKKNAICTEVEELQGQCSMALLEGACQQLLASGGGGSQEQYETPSPPDVPVGSTSGGADADAEDDPDKDDSWMQFISDDAWCSSTADGGAEESTSCVALAG

SEQ ID NO: 5227 - protein, 186 aa, Jankaea heldreichii
MLGFDKPSKTLDWLLTKSKVAIKDLVHTKKSSSPSASATPSECEVVLNGEDSKKRSKGAKDPTQIASTLAKESRVKARARARERTKEKMCIKKLNESGKMVSHLNPTIPNHSRDNNVRPTLHCPIMTDEANDDRIQESNLIKRMMRPPHPSIFGFHCDVNENWDISSLTSSKSNFCDILDQHKFIN

SEQ ID NO: 5228 - protein, 205 aa, Physcomitrella patens subsp. patens
MSSPSGGPVAQLQLPPGFRFHPTDEELVLHYLCRKAESKVFAIPVIAEIDLYKFDPWDLPGKAIFGEREWYFFSPRDRKYPNGARPNRAAASGYWKATGTDKPIHTAVGGIRKIGVKKALVFYEGRAPKGVKTNWIMHEYRLAEGVCASVHAHRKGSLRLDDWVLCRIYKKSTNAQRTGKERDSSSCVEEVTSHLDCMPDLTSFE

SEQ ID NO: 5229 - protein, 73 aa, Chlamydomonas reinhardtii
MQRHARSQIQGCGRSLQNSKLYYQRFKLCEDHLKRPAISIDGVLSRLCQQCGRFHELAAFEGKKRTCKAQVGG

SEQ ID NO: 5230 - protein, 219 aa, Oryza sativa Indica Group
MAPVGLPPGFRFHPTDEELVNYYLKRKVHGLSIDLDIIPEVDLYKCEPWELEEKSFLPSKDSEWYFFGPRDRKYPNGCRTNRATRAGYWKSTGKDRRINYQNRSIGMKKTLVYYKGRAPQGIRTSWVMHEYRIEESECENAMGIQLQDSYALCRIFKKNVVLGEFDKKGECSSSQAKGNEEQVTDFGDAGQSSGANENDKDNSWMQFIAEDLWCTNKLK

SEQ ID NO: 5231 - protein, 95 aa, Brassica oleracea var. capitata
MGRGRVEMKRIENKINRQVTFSKRRAGLLKKAHEISILCDAEVSLIVFSHKGKLFEYSSESCMEKVLEHYERYSYAEKQLKVPDSHVNAQTNWSM

SEQ ID NO: 5232 - protein, 215 aa, Populus trichocarpa
MSISMATTTEDSNNLQPPPPAVAPPPPPALAPPQQQSQQQSSTIPQYPEMIMAAVEALNEKEGSSKTSISKQIESTHPDLPPAHGTLLSHHLNKLKQSGQLVLVKNNYMKPDPNAPPKRGRGRPPKPKLPTPPGSVAGPPRPRGRPPKPRDPFAPVASPKKKTASPGSGRPRGRPPKNANTPVPAVSSGAAPPSGVPRGRGRPPKVKPAVAPVAG

SEQ ID NO: 5233 - protein, 95 aa, Brassica oleracea var. gongylodes
MGRGRVEMKRIESKINRQVTFSKRRAGLLKKAHEISILCDAEVSLIVFSHKGKLFEYSSESCMEKVLEHYERYSYAEKQLKVPDSHVNAQTNWSV

SEQ ID NO: 5234 - protein, 645 aa, Gossypium hirsutum
MGCWYSRIDREEIVSRCKARKRYMKQLVKARQTLGASHSMYLRSLRGTGSALLQFSSNETTTHSHHHTTPPPQQPALPPPMSPSSDTWTSANTASPVLPPPSPPQSSNWDFWDPFVPATESRSATEEEWEASTSVPEVAVTATNPTTRAASMAPPPSVVSGFSKDTGSELAMVVSRNSKELVEIVKEVDEYFIKAADAGSQLSLLLEVSNSNFPAQSKMSYFSLILFLFFFPLNISGWGFFFFLVAGKVYNYGCNLTPTTWAWNRNSKMEGTGKLGGDRTGENGNVGGTILNSSHSSTIERLYAWEKKLYEEVKTVETIRMEHEKRVAQLRKLELKRADYVKNEKTKKEVEKLESQMMVSSQAIETISAEIIKLREAELYPQLLDLVNGLMWMWRSMYEIHQVHTHIVQQLKYLNFMPSNEPTSEIHKQSTLQLELEVQQWHSSFCNLVKAQRDYIQSLAGWLRLSLFQFSKDPLLRNNEESKIYSFCEEWHLAIDRIPDKVASEGIKSFLTVIHAIVVQQAEEYKQKKKADSALKDFEKKAAELRSLESKYGPFSSMPEMNKYPVVEKRTKVEMLRAKAEEEKNKHEKSASVTRAMTLNNLQMGFPHVFQAMVGYSSVCMQAFESVYNQANGIDQEHDVKRILP

SEQ ID NO: 5235 - protein, 95 aa, Brassica oleracea var. gemmifera
MGRGRVEMKRIENKINRQVTFSKRRAGLLKKAHEISILCDAEVSLIVFSHKGKLFEYSSESCMEKVLERYERYSYAEKQLKAPDSHVNAQTNWSV

SEQ ID NO: 5236 - protein, 317 aa, Brassica napus
  misc_feature (57)..(57): Xaa can be any naturally occurring amino acid
  misc_feature (89)..(89): Xaa can be any naturally occurring amino acid
ILNSSRTFQQPVSFGGGGELMEALLPFIKSASDSPSSSASAFINPAASAFPLPTLPXPGYYPEHYLTQPFPYGSDLQQTGSLIGLNNLXSSSQIHQIQSQIHHNHPLPPTRSNLNLSPKPLLMKQPGVAGSCFAYGAPPKPAKLYRGVRQRHWGKWVAEIRLPRNRTRLWLGTFDTAEEAALAYDTAAFKLRGDFARLNFPNLRHDGSRIGGEFGEYKPLHSTVDAKLEAICQSMAETQKQDKTAKASKKRASTVKKTEKVDLSEKVSPVTEFVESAGSSPLSELTFADTEEQPRWNETFSLEKYPSYEIDWDSILS

SEQ ID NO: 5237 - protein, 576 aa, Arabidopsis thaliana
MEILLLSVKEAQSWQEAQVELHSEKHGSLSIDSRIRVRDVSQDTTFSGFRCFIDGSWKASDQFSGTGWFCLSSLGESPTMGAANVRRSLSPLHTEMEALLWAMKCMIGADNQNVAFFTDCSDLVKMVSSPTEWPAFSVYLEELQSDREEFTNFSLSLISRSANVKADKLARKIRTVPHHVTEMETPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 5238 - protein, 194 aa, Triticum aestivum
MRKARPPQPQPQPSQQSPEIRYRGVRKRPSGRYAAEIRDPAKKTPIWLGTFDCAEDAARAYDSAARSLRGPTARTNFPPSSATQPPPRPPPPAAAAAAATSSQSSTVESWSGGGPRAPARARSAARAGTAKEGEEDCRSYCGSSSSVLLEEGADDAAASRSPLPFDLNMPPPQEGALDAEADQMTCRYDTLLRL

SEQ ID NO: 5239 - protein, 405 aa, Brassica napus
RSFSHLKKTVIHSSSVLSNLSSTWTSKPPLEVKYRLDTTALEQPGGPKSLCSSLDRLLAWEKKLYEEVKAREGFKIEHEKKLSKLQSQEYKGDNETKLDKTKGSITRLQSLIIVTSQAVSTTSTAIVRLRDTDLVPQLVELCHGFMYMWKAMHQFHEIQNNIVQQVQGLINRSGKGESTSELHRQATRDLETAVSLWHSSFCRLIKFQREFIRSVQAWFRLTLLPVCHDENPGHKEPVDAYAFCDEWKLTLDRVPDTVASEAIKSFINVVHVISAKQSEELKIKKRTESASKELEKKASSLRNIERKYYQSYSTVGFGLPDSGPDNGHGLDARDPLTEKKLELGACQRRVEEEMLKHSKAIEVTRAMTLNNLQTGLPGVFQALTSFSALFTESLQTGCTRSYSIK

SEQ ID NO: 5240 - protein, 306 aa, Oryza sativa
NLCCCLLLLNSQIVTGIKQKMSNRATHWCYVCRRPVRIRGGSQDVTCPSCDDGFVQEMSEMGRRTASSTLGFVGPDAGDEFLLRRSPVMEAMSTLMRHAATVGGDEREVDVHDEHGGGDGVPAHARLGVLFRGGPRVGVERRGGYYRAGLEALFEQLQNQLGSSRQGPPPAPPSAIDAMPVVTISRRHLRAEPRCPVCQDEFQLGAEAREMPCAHLYHADCIVPWLVHHNSCPVCRHSLPPPATTASGGGASGGERQVRRGSRSFLWPFGPTSSTSHSHECEDGSSDTTVYEDPGKVRYIRWHYNH

SEQ ID NO: 5241 - protein, 388 aa, Oryza sativa Indica Group
MEPATETTATSPAAAAAAQPEAEAEAEAESAATPVAVAAAAAATYQPPAPVVPVAVAGAAAGRGNGKRKRGRPRKYGPDGSLLRPLKATPISASVPDDSGGGQYTPAAAVGAVMKRGRGRPVGFVSRASPVSVAVTAATSTAAVVVSSPATHTQTPLGPLGELVACASGANFTPHIINVAAGEDVNMKVISFSQQGPRAICILSANGVISNVTLRQQDTLGGTVTYEGRFELLSLSGSFTPTDSGGTRSRSGGMSVSLAATDGRVIGGGVAGLLVAASPVQVVVGSFLPSYQLDQNATKKPVIEITTVPPPPPAIGFTISSGDPMEDSYSGSHGQHRSGAAAATTTTAKANSTSAFRLENWTPPAPPAAEAARTKTPSSEAKVPVPGA

SEQ ID NO: 5242 - protein, 170 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDTSHHLINLVTW

SEQ ID NO: 5243 - protein, 436 aa, Zea mays
MPCLEQIPMATGETAVDRREDHRDMDLSGEEHVRPKARKPYTITKRRERWTEDEHGQFLEALQLHGRAWRRIQVHIGTKTAVQIRSHAQKFFTKVVRESSPGSNASAGAAPAIQIPPPRPKRKPAHPYPRKADGAAKKPAPELKRLEKTSLRDRVRDEGSPTSVLASARTASRAEVSGSLVANSSSASRSPALSDAGSDERGDGGGSLASSVDREDGCASPRTRAPCTKVLCHAHEVSRLGSGAPVVKLFGNKVVVVKVKDLETDTPPASVAEAARNGSPPNGAAGASSWKPWPELTCLVPRRDGFAAQPVVSPPCAVFYYPQASAASAQEHQQASEPLDHRRAQREGSSPTGSSVASSAAAESRHGPVQENASDGYAALRAAIPRPTKRVSSASFGGRGFVPYKRCAAESEAARPVALALAPGEEADGDLTRLCL

SEQ ID NO: 5244 - protein, 380 aa, Hordeum vulgare subsp. vulgare
MDAAHWPQGLGLVKPMEEMLMGAPSANQVQGSNPNAPAQAPSSAPGAAGAMRGAPPAMAVAVSGVGAGSTERRPRPQKEKAINCPRCNSTNTKFCYYNNYSLQQPRYFCKTCRRYWTEGGSLRNVPVGGGSRKNKRSSSSSSASASAAASATASAANSSMLGAAPNKNPKLAHEGAAHDLNLAFPHHQGGMQAQADYMAFPSLESSSMCNPGGGGMAGNGARASGALSAMELLRSTGCYMPLQMPMQMPGDYGAAGFSLGEFRAPPPPPQSQSQSLMGFSLDAHGPVGGASSAGYGSSAAMQGMQDRASRLLFAFEDLKPTASSGGAGGGESGGGSGGAADGGGHQFEQGNKEQQGNGTPVGQPDTPGFWNGMIGGGGTW

SEQ ID NO: 5245 - protein, 195 aa, Glycine max
MAKEGLGLEITELRLGLPDAEHQVSVVNKKNEKKRAFSEIDDGVGDENSSSGGGDRKMETNKSQVVGWPPVCSYRKKNSMNEGASKMYVKVSMDGAPFLRKIDLGLHKGYSDLALALDKLFGCYGMVEALKNADNSEHVPIYEDKDGDWMLVGDVPWEMFMESCKRLRIMKKSDAKGFGLQPKGSLKGFIESAAK

SEQ ID NO: 5246 - protein, 156 aa, Pisum sativum
KNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 5247 - protein, 234 aa, Nicotiana tabacum
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 5248 - protein, 335 aa, Medicago truncatula
MSPTAVVTEDEGRRKLSSTMERNYLGLSDCSSVDSCDSTLPSLCDEKKVNLNLKATELRLGLPGSQSPEREMDSDFYLTKLDEKPLFPLLPAKDGLQKNVVSGNKRGFADTVDGFSQGKFNGNTGINVMLSPRPAGAQASTVKEMPSKVLQERPCAARGTAGHNHAGAASVAGCAPASKAQVVGWPPIRSFRKNSMGTASKNNNDEVDGKPGPAALFVKVSMDGAPYLRKVDLRTYATYQQLSSALEKMFSCFTLGQCGSHGAPGKEMMSESKLRDLLHGSEYVLTYEDKDGDWMLVGDVPWEMFIDTCRRLKIMKGSDAIGLAPRAMEKSKSRS

SEQ ID NO: 5249 - protein, 216 aa, Brassica napus
STHASDHDQYQHHQMTITNNNSYNTIITTPPPRTTTTVDSTTMIMDAEKKMMTTMTSRPQEPRNCPRCNSSNTKFCYYNNYSLAQPRYLCKSCRRYWTEGGSLRNVPVGGGSRKNKKLPLLQPNSSSSSPAKNLPDLNPPFAFTSSSSTSTSSNPSKSTHQNNNDLSLSSYPTMQERAQGHYGHFTDQAMSGGQNCLFSAPMGMIQFRQDYGHDHN

SEQ ID NO: 5250 - protein, 207 aa, Triticum aestivum
MRRGGGAATAVAAAAEAERDAGARFRGVRKRPWGRYAAEIRDPAKKARVWLGTFDSAEDAARAYDAAARMLRGPKAKTNFPLSLPHHHQLQASYSPYPVAAAAAVPTSVAAAAARPACSSLSSTVESFGGPRARPVLPPRPPPPPILDGDCHSDCGSSASVVDDDCADAAASPSCGLLLPFDLNLPPEFGGVACNDDDELKLTALRL

SEQ ID NO: 5251 - protein, 248 aa, Populus tremuloides
MGRGRVQLKRIENKINRQVTFSKRRTGLLKKAHEISVLCDAEVALIVFSHKGKLFEYSTDDCMEEILERYERYSYAERQLVATDLDSQGDWTLEYNRLKAKVELLQRNHRNYVGEDLDSMSLKELQNLEQQIETALKHIRARKNHLMSQSISEMQRKEKAIQVQNNMLVKQIKEKEKKDKAVAQPAFWDQQNHGPDASSFLLSQPAGLPLPCLNIGGSYQEEAPEARRNGLGHTLEPIYSFHLGGYGA

SEQ ID NO: 5252 - protein, 167 aa, Oryza sativa Japonica Group
MGRSPCCEKEAGLKKGPWTPEEDQKLLAYIEQHGHGCWRSLPTKAGLRRCGKSCRLRWTNYLRPDIKRGKFTLQEEQTIIQLHALLGNRWSAIATHLPKRTDNEIKNYWNTHLKKRLARMGIDPVTHKVNSSMSSSSSSLTSEVVTDTEMFLPATAAAAASATPVEF

SEQ ID NO: 5253 - protein, 55 aa, Glycine max
  misc_feature (9)..(11): Xaa can be any naturally occurring amino acid
LRAVCPTTXXXICRQHGITRWPSRKIKKVGHSLRKLQLVIDSVQGAEGAIQIGSF

SEQ ID NO: 5254 - protein, 240 aa, Populus tremuloides
MGRGRVQLKRIENKINRQVTFSKRRAGLLKKAHEISVLCDAEVALIVFCHKGKLFEYSTNACMEKILERHERYSYAERQLVATDLDSQGNWTLEYNRLKEKVELLQRNHRHYLGEDLDSVSLKELQNLEKQIDTALELIRERKNHLMYQSISELQIKEKAIKEQNNMLVKQIKEKEKALAQPALWDQQDHGPNASSFLLPQPPLPCLNISYQEEDPIARRNELDLTLEPIYSCHLGCFGT

SEQ ID NO: 5255 - protein, 240 aa, Brassica napus
VDPRVRAHAQAQAREHVTKRPEMVEETAKSRDGNCRLFGIPLVNNVNGTDSTMSPRNNFNDTAGLTQMTSPKVQDLSDQSKGSKSTNDQREQGRPFQANHPHPKDVHTKTHSSRSCTKVQKQGIALGRSVDLSKFQNYKELIAELDRMFEFNGELMAPKKDWLIVYTDDENDMMLVGDDPWQEFCGMVRKISIYTKEEVRKMNPGTLGCRSEEEAVVGEGSDPKDAKSASNPSLSSAGHS

SEQ ID NO: 5256 - protein, 220 aa, Triticum aestivum
MKTKQASKAKAAPSPGKEEEAVAPGGFRKGPWTEQEDMKLAWFVRLFGERRWDFLAKVSGLNRTGKSCRLRWVNYLHPDLKRGRMSPEEERLVVDLHARWGNRWSRIAKAMPGRTDNEIKNYWRTHTRKLHKDTRASAASASTTTSTSMSAASPATTSSSSSSTIDNDNNSHHGHRDQETGPVRNKGITVALNGRIGLEITSFGKDPLVAPTHWEPPVPL

SEQ ID NO: 5257 - protein, 162 aa, Physcomitrella patens subsp. patens
RKPRGRPPGSKNKPKPPVIITRENGNAMRPHILEVAGGCDVGDSVASFSRRRQRGICVMGASGTVSNVTLRQPTTPGATVTFHGRFEIISLSGAFLPHPSSAPTTGLTVSLAGAAGQVLGGSVVGTLMAAGPVLVIAASFIGLTYERLPLDNDDDGLTMGPG

SEQ ID NO: 5258 - protein, 215 aa, Triticum aestivum
  misc_feature (17)..(17): Xaa can be any naturally occurring amino acid
GRRGKGEFGKGKGKANXATERERREQLNVKYKTLRMLFPNPTKNDRASVVGDAIEYIDELNRTVKELKILVEQKWHGTNRRKIRKWDEEAAADGESSWMRPMRDEQDNQLDGAIRSSWVQRRSRECHVDVRIVENEINIKLTEKKKTNSSLLHVAKVLDEFHLEIIHVVGGIIGDHYIFMFNTKVTEGSSVYACAVAKRILQAVDAQHQALDIFN

SEQ ID NO: 5259 - protein, 439 aa, Beta vulgaris subsp. vulgaris
MKIKTSPSFLLGLICLALVLLLGEGVQCGRQCNTTDTNCLSGCSVGRPSRPTPPRPPTPRPPPPRPPTPRPPPPRPPTPRPPPPTPRPPPPRPPTPRPPPPPTPRPPPPRPPTPRPPPPPTPRPPPPPTPRPPPPSPPTPRPPPPPPPSPPTPSPPSPPSPEPPTPPEPTPPTPTPPTHLTDIISEEMFNEFLLNRIQPRCPGRWFYTYQAFITAAETFPEFGNTGNDEIRKREIAAFFGQTSHETSGEPTAQHGPFTWGYCFIEEIGAGPLSQYCAPSVEWPCIRGRFYYGRGPVQLTWNFNYGKQVKHLGLDLLFNPDIVAHDPVISFETAIWFWMTPEGNKPSSHEVITGQWTPTPADIARNRLPGYGLITNIFNGALECGTHGPDNRGENRIQFYQRYCDLLDVSYGDNLDCYRQTPFDWGLKKLQGARESWSSS

SEQ ID NO: 5260 - protein, 361 aa, Oryza sativa Indica Group
MAGRSDNGDGALTKCVNQEELHHDEHFSFIYKWKNKISSAGNARLYYHYGYNFGMISSKSELRKIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 5261 - protein, 217 aa, Triticum aestivum
MAPKNALPVAVAAAADAGMEPRFRGVRKRPWGRYAAEIRDPARKARVWLGTFDTAEAAARAYDAAALHYRGPKAKTNFPVGTVAAFAHVPLPPPKALAVSPSSSTVESSSRDTPAAAPAAPAAAAPAPPPALDLSLAMPAMVAAQPFLFLDPRVAVTVAVAAPAPAPCRSAAISGMNKVASREEEQSDTGSSSSVVDASPAVGVGFDLNLPPPVEMA

SEQ ID NO: 5262 - protein, 249 aa, Vitis aestivalis
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGVGVGVGVGAAAGYATAMRFPFQHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 5263 - protein, 405 aa, Arabidopsis thaliana
MTESIDLNRSESESDNNTDDVTPIFAIDDSSKGYRRVSGPTRRSTKGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLEQFPSNLFSGVVYGSKPSSGFEYNFFNQRNTMVESCITSQIKEAAKSPQRDFLDLTLGLNWRSISSSTSSLRGEESVSSSVDSVCARLNVSACLETPQNSNNDTVCVKEVREMKERLRMAARTFDTPSIISKTSSPASGLKRLRQKYDTPFPTDARSHMSSEEDHSVSASPSSKYRFVKRNTCSGSKPLERRLDFDFL

SEQ ID NO: 5264 - protein, 247 aa, Zea mays
MVRMKQVKISVKKDVDSYTIRGTNKVVHGNSPHPRSGCIFSCERYLMLLQCLCWEVGDCVLMRASDSDKQPYVARVEKMEADGRGSVRVQVRWYYRPEESKGGRRQFHGAKELFLSDHFDLQSAHTIEGKCVVHSFKNYTKLDNVGPEDFFSRFEYNAATGSFTPDRVAVYCKCEMPYNPDDLMVQCDACKHWFHPSCVAMTIEQAKKLDHFVCSDCFKENGSKRLSNAYATSPNFEPKAEPKRQRR

SEQ ID NO: 5265 - protein, 220 aa, Vitis aestivalis
MAPRDKPTGVTAGATGNKEIRYRGVRKRPWGRYAAEIRDPGKKSRVWLGTFDTAEEAARAYDAAAREFRGAKAKTNFPSPTDLAAAAATTANRSPSQSSTVESSSREALSPGAIAGPPALDLNLSHPAAAGQFSAVRYPAVGVFPIAQPLFFFEPFSRPEKPKTHRDMFDLDRAVADFHPAIAGSVHSDSDSSSVVDFNYHDRSTRLLNLDLNHPPAEVA

SEQ ID NO: 5266 - protein, 231 aa, Lycopodium annotinum
MGRGKIEIKRIENATSRQVTFSKRRGGLLKKAHELSVLCDAQVALIIFSSTGKLFEYASPSMKEILDRYGKYPEGVQTGTVTDPNNDVMLQYLNREVIRMKQQIERTHQTQRHMMGEDLAILPLKDLQQLEEQLDIGLRRIRARKDQLLVEQLEELHRKERHWLEENEALRRKLAGGQALSGPVPSPLSIVNPLETREPPSLGTVSLPFSVQFNQQNMQDTPNLQTSLQLG

SEQ ID NO: 5267 - protein, 483 aa, Physcomitrella patens subsp. patens
MVGMQESADAANRSGGGGMGSPQRAGMASGVGHGLHTAAPVRHSPPPSSSPSPSPGITPSQSAQGGAPAVSTPVPEAGPSGLHPHPIMAVAPPASLGMSLGIVGTSITGPRSASGGEQPLKRKRGRPRKFSTGSEFSPGTPGAGYPVFPAIMPAPSSPYTPSPDKRGRGRPTGSGKRQQLAALGVVLAGTGQGFTPHILTVNTGEDVATKIMQFAQHGPRAMCVLSANGAISNVTLRQQLSSGGTVTYEGRYEILSLSGSYLPTDLGGGARQRTGGLSVSLAGSDGRVIGGGVAGMLTAASPIQVVVGSFLSDAYKSQPKSDSPLSSTPGGSSGGGFVPGLGLGGPRPPPLRPEMKPSPGLFSNSKAPSPQQTSPAPPSPTGQVSAQRPQTMGLFQPMASWQPPALGDGRRTDINISLPGGQKCRDLVLVASFSVFRHQLRIVILNSYPPLAVALHLFEHSIMETALILIFGLSVAPISKMYP

SEQ ID NO: 5268 - protein, 238 aa, Nicotiana tabacum
VKPMEEIIPKNTNTITTICSSKPSTHIERKIRPHQKDQALNCPRCNSTNTKFCYYNNYSLSQPRYFCKTCKRYWTEGGSLRSIPIGGGSRKSKKSSSTNCSSSNTVLREFSKNVVAPVLDPPKMEGSQDLNLGFSCDFKTISELIQVPNNSFMPMPISDPNSVYSSLNFSLDYGLGISGDYENNLQDVQDSTTSGRLLFPFEDLKQISNTSIDCAEENRDGESNGYWNAVLGGNGGSW

SEQ ID NO: 5269 - protein, 119 aa, Ceratonia oreothauma
RVRLSIEIARKFFDLQDMLGFDKASNTLEWLFTKSKKAIKELTRTKNSSSNGAKSFSSSSECEEVVSGINQVTDVIPNLHELDKDSNDKSFVGTRERKLKRTQKEAVCVWAKKKESREK

SEQ ID NO: 5270 - protein, 247 aa, Zinnia elegans
MKRHGSSDSVGLMPMCHTLDETREFHSMLMEGLDDDCGGVDGGECDRGLISEKKRRLTAVQVKALEKNFEMENKLEPERKVKLAKELALQPRQVAIWFQNRRARWKTKQLERDYGVLKSNFDSLKHKYESLKQDNESMVKQIKELKSKLYEEDEPDNIPMPEQSDDKPKSPENMVETAYFPDFKDGSSDSDSSAIMGDAQKAYQPQFVKLEEHNFFGGDESCNFFSDDQAPTLQWYCQDQWNLSEEN

SEQ ID NO: 5271 - protein, 237 aa, Lycopodium annotinum
MGRGKIEIKRIENATCRQVTFSKRRSGLLKKAHELSVLCDAQVAVIIFSSTGKLFQFASTRMKEILERYERNSDPLQIDAVIPRDLEYWSREAAKAKDELDRCHQKNRHMLGEDLSALNLNELEELEQQLDSGLRRVRCRKDQVLRDRIEELTKQESFLREENRMLRSKIAVPKESTEPILDEMNMETREPPSMAIVEEELSLKLNSKTWPDIHFSLQLGQYQPPRTETPTANHRPN

SEQ ID NO: 5272 - protein, 372 aa, Oryza sativa Indica Group
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGTSEQQQIGPQGELNDNFWEELLNEGLVGEENDNPVVEDDMNVLSEKMGYLNSNGPTAGE

SEQ ID NO: 5273 - protein, 282 aa, Triticum aestivum
  misc_feature (131)..(131): Xaa can be any naturally occurring amino acid
MGRAPCCEKMGLKRGPWTPEEDKILVAHIHSHGHSNWRALPKQAGLLRCGKSCRLRWINYLRPDIKRGNFTDEEEQSIIQLHQLLGNRWSAIAARLPGRTDNEIKNVWHTHLKKRLDPSAQERHQEASAAXKRKKPAAAARKREGKVKMRKLDALTAKAAPVLSSPERSVSSTLTESTSTASAAAEQHGNSGSSASASASVKEECFTSSEESEEFQIDESFWSETLSMPLDDINDVCMEPHDAFGKPAGADGGDMDYWLKVFMEGGGDDDDNNDGALDLPQV

SEQ ID NO: 5274 - protein, 125 aa, Dialium guianense
RVRLSIEIARKFFDLQDMLGFDKASNTLDWLFTKSKRAINELARTKHSCSAKSFSSSSECEEVVSQTNNNDIFHESSTDPAPSNLQTQQGVVVGMVEDSSGKEKKLKRAQKGAAVCVAQANNESR

SEQ ID NO: 5275 - protein, 222 aa, Canavalia lineata
MARQKIKIKKIDNVTARQVTFSKRRRGIFKKAEELSVLCDAEVGLIIFSATGKLFEYPSSSMKDIITKYNQHSHDNNQLGRPQNLQVEQCVDLSKEVAERNQQLRQMKGEDFQGLNLDDLQQLEKTLETGLERVNETKEKRIMDEIVALHKKGLKLEEENKHLKQKMAMLCMGKSSFLVDSDITLQEVVSSESMNVCSCNSGPSLEDDSSDTSLKLGLPFPN

SEQ ID NO: 5276 - protein, 218 aa, Triticum aestivum
MAKTRPPKKILESYTIKGSDKVIKPGDCVLMRSADTSKPPYVAKVESIEAAGSRGTNVRVRVRWYYRPEESIGGRRPFHGSKEVFLSDHYDVQSADTIEGKCNVHSFRSYTKLDSVNAEDFFCRFDYKSASGSFVPDRIAVFCKCEMPYNPDDLMIQCEECSDWFHPSCIGMTIKEAKKREHFFCQSCTAENGKTTENFHEATAESEEKLVESKRRRR

SEQ ID NO: 5277 - protein, 310 aa, Arabidopsis thaliana
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKISLAEETGLDQKQINNWFINQRKRHWKPSENMPFDMMDDSNETFFTE

SEQ ID NO: 5278 - protein, 267 aa, Arabidopsis thaliana
MEVLIPVDEMTEGGEYSPAMMSAEPFLTMKKMKKSNHNKNNQRRFSDEQIKSLEMMFESETRLEPRKKVQLARELGLQPRQVAIWFQNKRARWKSKQLETEYNILRQNYDNLASQFESLKKEKQALVSELQRLKEATQKKTQEEERQCSGDQAVVALSSTHHESENEENRRRKPEEVRPEMEMKDDRGHHGVMCDHHDYEDDDNGYSNNIKRECFGGFEEEPDHLMNIVEPADSCLTSSDDWRGFKSDTTTLLDQSCNNYPWRDFWS

SEQ ID NO: 5279 - protein, 380 aa, Arabidopsis thaliana
MDLRLQQAAESGSINELYALIDENPYILENIDAVPFVSTPLHVAAVFGNIEFAMEMLNLKPSFARKLNTSGYSPLHLAVEKEQSDFVSHMLWHDGGLSRVKGRNECLITSPECIEDVNVDRQNALHLAVMNDRFEVLQALKLLLKCRLVEPNLVNIDDLTFVDILRTQGENAGGGNLDLEQAVIKTGCVEAASMPKFKEESDLLKSPINFMTYYSTSMKRMKSSTSDQDRGAFLIVCTLIITATYQMALQPPGGVHQSENANANAGSVVMKQTFFILLWISNTVGFCCAVFYTFCLIPLGQLFTIWFFYIGTCLCISYALAMAVISPHPLVFLSATFALFLVFALYLLLEAFVDTWRKHRTVVPKSRFSWFWKVLQYYYI

SEQ ID NO: 5280 - protein, 242 aa, Oryza sativa Japonica Group
MCRGGLQVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 5281 - protein, 227 aa, Oryza sativa Japonica Group
MSPAAAATGLALGVGGVAGAAAVGTGQHFRGVRKRPWGRYAAEIRDPAKKSRVWLGTFDTAEEAARAYDAAAREYRGAKAKTKFPYPNGAPAAGVNSGSSNSSTVESFGSDVQAPMKAMPIPPSLELDLFHRAAAAAAAGAGGMRFPFEGYPVSHPYYFFGQAAAAAAASGCRMLKIAPAPVTVAALAQSDSDSSSIVDLAPSPPAALAKKAIAFDLDLNCPPPMEV

SEQ ID NO: 5282 - protein, 107 aa, Zapoteca tetragona
RVRLSIEIARKFFDLQDMLGFDKASNTLDWLFTKSKKAIQELEKTAARIGSKKMSSGSSKSKTCKSLSSSSECEEAVVSPQRAVDSDSAKLMMMRRPETAKKESREK

SEQ ID NO: 5283 - protein, 91 aa, Pisum sativum
RVRLSIEIARKFFDLQDMLGFDKASNTLEWLFNKSKEAIEELTRSKNNLASGDDDVDDHSFSTSSSEGEDEARKMKRAQKESSKMKDSREK

SEQ ID NO: 5284 - protein, 472 aa, Hordeum vulgare subsp. vulgare
MTYGGERRGSNPTTVIHKTFLPLPLFRVLETTSSSCSSPSFPRPSFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 5285 - protein, 821 aa, Arabidopsis thaliana
MSTYYYHIDSMNWLPEAEAEDDFKGLLSGDFFDDLINHLDVPLDDIDTTNGEGDWVDRFQDLEPPPMDMFPTLPSDLTSCGSGMAKAPRVDIQRNIPALVSSFYSYNLSDVNLSLSAVFITIVSSIHVEGIPNPSIILCHLLYWCIDCVPDFAIHLICLVSLVQKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRGLKTDTLVKLNDNRERLENKSFFHRDERLTYKKFQLKPSFVSLRSYKITLYKMLTLNSNFMIHFPVIVIVELFHSSVFRSSAISLFIFIACSMPFSVTCASTPTNSTSLSKKDLSEPFGIKDSVLTSGIGNVEAHYMNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 5286 - protein, 218 aa, Pisum sativum
MGRGGATTAAAAVEPVFFKEPRYRGVRKRPWGRFAAEIRDPLKKARVWLGTFDTAEEAARAYDTAARNLRGPKAKTNFPLAQPFYQNPEAGNPFGELRFYAGGAGEGFQDHRRPTSSGMSSTVESFGGPRPVRPPMPPSAVTGRRYPRTPPVAPGDCRSDCDSSSSVVDDADNDNAASSTMLSFKRQPLPFDLNAPPLEEGDVANGLGEDLHCTLLCL

SEQ ID NO: 5287 - protein, 109 aa, Anthyllis hermanniae
RVRLSIEIARKFFDLQDMLGFDKASNTLEWLFSKSDKAIEELFQSENSNNNSTGGGGDGDGGGDNDDDHSFSSNSSSEDGGEVVSVKRAQKEKEPSNCVQVKMKESREK

SEQ ID NO: 5288 - protein, 119 aa, Anthyllis hermanniae
RVRLSIEIARKFFDLQDMLGFDKASNTLEWLFNKSKRAIKDLAQSSNNNNEGDGANNKKFSFFSEEEEDEVCEVESSNLQHHEEGLDSNQNKEILNNKLKRAQKEPSCARAKMKESREK

SEQ ID NO: 5289 - protein, 100 aa, Anthyllis hermanniae
RVRLSSEIARKFFDLQDMLEFDKPSNTLEWLFTKSESAIKELARSKNCSSCNNNNNPSPHFVDSNNNKSLADSRGRSKLKWTQRDQDVCVLQNKKESRER

SEQ ID NO: 5290 - protein, 184 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFASHHLINLVTW

SEQ ID NO: 5291 - protein, 817 aa, Saccharomyces cerevisiae
MAGAPAPPPPPPPPALGGSAPKPAKSVMQGRDALLGDIRKGMKLKKAETNDRSAPIVGGGVVSSASGSSGTVSSKGPSMSAPPIPGMGAPQLGDILAGGIPKLKHINNNASTKPSPSASAPPIPGAVPSVAAPPIPNAPLSPAPAVPSIPSSSAPPIPDIPSFAAPPIPIVPSSPAPPLPLSGASAPKVPQNRPHMPSVRPAHRSHQRKSSNISLPSVSAPPLPSASLPTHVSNPPQAPPPPPTPTIGLDSKNIKPTDNAVSPPSSEVPAGGLPFLAEINARRSERGAVEGVSSTKIQTENHKSPSQPPLPSSAPPIPTSHAPPLPPTAPPPPSLPNVTSAPKKATSAPAPPPPPLPAAMSSASTNSVKATPVPPTLAPPLPNTTSVPPNKASSMPAPPPPPPPPPGAFSTSSALSASSIPLAPLPPPPPPSVATSVPSAPPPPPTLTTNKPSASSKQSKISSSSSSSAVTPGGPLPFLAEIQKKRDDRFVVGGDTGYTTQDKQEDVIGSSKDDNVRPSPISPSINPPKQSSQNGMSFLDEIESKLHKQTSSNAFNAPPPHTDAMAPPLPPSAPPPPITSLPTPTASGDDHTNDKSETVLGMKKAKAPALPGHVPPPPVPPVLSDDSKNNVPAASLLHDVLPSSNLEKPPSPPVAAAPPLPTFSAPSLPQQSVSTSIPSPPPVAPTLSVRTETESISKNPTKSPPPPPSPSTMDTGTSNSPSKNLKQRLFSTGGSTLQHKHNTHTNQPDVDVGRYTIGGSNSIVGAKSGNERIVIDDSRFKWTNVSQMPKPRPFQNKTKLYPSGKGSSVPLDLTLFT

SEQ ID NO: 5292 - protein, 120 aa, Glycine max
IITMNDSLISAAQVGDIDLLYKLIQMQPYVLEQTDFMPFVDTPLHVAAAAGHASFATEIMRLKPSFAWKLNPCGLSPMHLALQNKHYRMVCRFVDINKNLVRVKRRGGLTPLHLQLKPGE

SEQ ID NO: 5293 - protein, 350 aa, Lithachne humilis
FGLGASSHGHGHHHHHHHHPWGSSLSAVVAPPPQPPSAGAGAGMPNTPLTLNTAPTPGGNGGGGCGNPVLQLANGSLLDACAKAKEPSAPSSSYAADVEAIKAKIISHPHYSSLLAAYLDCQKVGAPPEVAARLTALAQDLELRQRTSLSGLGAATEPELDQFMEAYHEMLMKYREELTRPLQEAMEFLRRVESQLNSLSISGRPLRNILSSGSSEEDQEGSGGETELPEVDAHGVDQELKHQLLRKYSGYLSSLKQELSKKKKKGKLPKDARQQLLNWWDMHYKWPYPSETQKVALAESTGLDLKQINNWFINQRKRHWKPSDEMQFVMMDGYHPTNATWTAASSTTAG

SEQ ID NO: 5294 - protein, 337 aa, Arabidopsis thaliana
KKNYLRNICFGSSKGLILYRNQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 5295 - protein, 360 aa, Leersia virginica
FGLGTSGHGGHHHHHQGHQQQQQQHHPWASSHSAVVAPPPPQTQQQSQAVTMAHSPLTLSTAAAAAAAAGVPVLQLANGNLMDACGGSGKAKEASASASASFAAVNVEAIKAKIISHPHYSSLLAAYLDCQKVGAPPEVAARLAAVAQDLELRQRTALGGLGAATEPELDQFMEAYQEMLVKYREELTRPLQEAMEFLRRVETQLNTLSISGRSLRNILSSGSSEEDQEGSGGETELPEIDAHGVDQELKHHLLNKYSGYLSSLKQELSKKKKKGELPKDARQQLLSWWELHCKWPYPSESQKVALAESTGLDLKQINNWFINQRKRHWKPSDEMQFVMMDGYHPTNAFYMDGHFINVSG

SEQ ID NO: 5296 - protein, 336 aa, Pharus lappulaceus
YGVLGAGASTTTHHHHPWASSLSAVVAPPPPLPPTPLTLTTTPTATTTTNNPVLQLANGNLLDACGGKAKDPSSSSSYAADVEAIKAKIISHPHYSSLLAAYLDCQKVGAPPEVATRLTAVAHELEARQRTALGGLGAAMEPELDQFMEAYHEMLVKYREELARPLQEAMEFLRKVELQLNSLSISGRSLRNILSSGSSEEDQEGSGGETELPEIDAHGVDQELKHQLLKKYSGYLSTLKQELSKKKKKGKLPKDARQQLLNWWELHYKWPYPSESQKMALAESTGLDLKQINNWFINQRKRHWKPSDEMQFVMMDGYHPTNAAFYMDGHFINDSG

SEQ ID NO: 5297 - protein, 301 aa, Arabidopsis thaliana
MNHNSKMIRSMFTTSDFSNHRDLFSSSPSFSCYQNSHVSSSSFGFNNSQVMRRNIDYVSSTDYLPIKDNPHLTRVSFTQTITNRYSSIVPTNSLDAVQYDIELVKRAMDSKPNIWNPVFYPPNFLGKQCEILNPEPLNVIFPHQNSGDRQYLNMFSLSSKHNHDQNVFHEGRSSTKIPKPTMSIEKTTEYIDCEENEKSDDAQYDGRIHSLPYKKYGPYTCPKCNSIFDTSQKFAAHMSSHYKSETNKERAQRFRARNKRKYRKLNLEVYGESQKIKQEDGVHNDGRSDDKPIQHHKILFR

SEQ ID NO: 5298 - protein, 228 aa, Oryza sativa Indica Group
MGSSDQKVIGIAAAAAAAAAAAEEAGRRCCVECGATTTPMWRGGPTGPRSLCNACGIRYRKKRRQELGLDKKQQQEHHPHHHQQQQQQYQRQQQQQQQEDHSDAASSVKDSSSSSSNKSSSLQVISEIVISRSESDCEGAMEGNCVPLKRLVQQVDFLLSSTGITESFQCVAVSCANQMGLQKAANVLLILVPIRVLTMENNSCDILHIIRIIGRGCGIESKTRIIDR

SEQ ID NO: 5299 - protein, 195 aa, Theobroma angustifolium
CPVKKKVERSFDGQIAEIVYKGEHNHSKPQPPKRNSSGTQGLGFTSDGTGQDTNNSLWSNNPNERNEGSEGRVENQNEVRLSAPPSYQGKAVLSYEHATTGAVNAGVTSENSIGLSGECEERSKEGEDEPRSKRRKSENQSSEVGTSGDGVQEPRVVVQSCTESEIMGDGFRWRKYGQKVVKGNSYPRSYYRCTS

SEQ ID NO: 5300 - protein, 55 aa, Physcomitrella patens subsp. patens
QWRTGPMGPKTLCNACGVRYKSGRLLPEYRPAGSPTYEASRHSHSHKKVLEMRRE

SEQ ID NO: 5301 - protein, 196 aa, Theobroma bicolor
CPVKKKVERSFDGQIAEIVYKGEHNHSKPQPPKRNSSGIQGLGFTSDGTGQDTNNSLWSNNPKERNEGSEGRVENQNEVGLSAPPSYQGKAVLSYEHVTTGAVNAGVTSENSIGLSGECEERSKEGEDDEPRSKRRKSENQSSEVGTSGEGIQEPRVVVQSCTDSEVMGDGFRWRKYGQKVVKGNPYPRSYYRCTS

SEQ ID NO: 5302 - protein, 151 aa, Triticum aestivum
MDGEWSDGAVSGGEQKASGDGVSADCNSPGSPSPPAVPSTSGRRRSLQKRVVTVPLADLNVPRPKGVGEGNTPTDSWAWRKYGQKPIKGSPFPSRAYYRCSSSKGCPARKQVERSQADPDTVLITYSYEHNHSSTVARAQSRPTPTPKPNK

SEQ ID NO: 5303 - protein, 333 aa, Oryza sativa Japonica Group
MADASSRTDTSTVLDTDDKNQMVDGQSGAIVPSNSSDRSDRSDKPMDQKVLRRLAQNREAARKSRLRKKAYVQQLESSKLKLASLEQEINKARQQGIYISSSGDQTHAMSGNGAMTFDLEYARWLEEQNKQINELRTAVNAHASDSDLRLIVDGIMAHYDEIFRLKGVAAKADVFHILSGMWKTPAERCFLWLGGFRSSELLKLLVNQLEPLTEQQLLGLSNLQQSSQQAEDALSQGMEALQQSLADTLAGSLGPSGSSGNVANYMGQMAMAMGKLGTLENFLRQADNLRQQTLHQMQRILTIRQAARALLAIHDYFSRLRALSSLWLARPRE

SEQ ID NO: 5304 - protein, 275 aa, Oryza sativa Indica Group
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPVDGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 5305 - protein, 105 aa, Lotus berthelotii
RVRLSIEIARKFFDLQDMLGFDKASNTLEWLFSKSNKAIEELFRSKHSDNNNSTAGACAADGDGDGDDYSFSSSSSEDEVVSVKRAQKEKEPSCVQAKMKESREK

SEQ ID NO: 5306 - protein, 463 aa, Oryza sativa Japonica Group
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAASSIQIPPPRPKRKPVHPYPRNLGSTASKNIPALKQLEKPQLQVQSLYDQDNGSPTSVLTVPQIRADTLGSESGGSPTSTIDIEERCPTPSIATAELAMELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVADSEALLKSQAPQEEADGEMTRLCL

SEQ ID NO: 5307 - protein, 381 aa, Medicago truncatula
MEGSSNGSCSYVMGAFGENSGGLCPPMMMMPLVTSSHHNAHHPINSNNNNNNNNNNTNANNTTGLFLPIPNSTNNNNNHYTNCNNNTSSIMLQNNHQNTPGLGYYFMDNINNHGSSSSSSSSSVKSKIMAHPHYHRLLEAYINCQKVGAPSEVVARLEEACATAVRMGGDAVGSGCLGEDPALDQFMEAYCEMLIKYEQELSKPLKEAMLFLQRIEVQFKNLTVSSSSDNIACSEGGDRNGSSEEDHVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLTNSYPMDLSNTML

SEQ ID NO: 5308 - protein, 601 aa, Oryza sativa
MVKSGQEAAPGSGGNAAAAAARQGGGGGGRGRQYKGVRMRSWGSWVSEIRAPNQKTRIWLGSYSTAEAAARAYDAALLCLKGSAADLNFPVHLPFHIPAAAMSPKSIQRVAAAAAANATSPLQHHSGAPSFATATGGYNPAAAPTTPPCSYGDMSSCSAVSSPETANYYGADHDMVAREDDVDYAALADIDAFFQSPKCMDYSMMDPCSTFFSPAPESLAAEWEDEASHPNPRGRDSLAFALLVSFLPSAAAAAAARAMGYTKEQLLARLQELNIEFSCYDHPVVLTVEEQAKHVGHLGGALSKNLLLKDKKHRLYVVSALAGTKVDMKILSQRLGLGKGGLRMAPEENLLEVLQVPLGCVTPFALLNESASFFHGYAIAFLTDSYNCVFASSAVSLLLDQGFKSKQSCYFHPLTNDVTIALSSSNLDKFLMSIGRQPAYVDLEASPVVGKDNPPDLADFVPSGVPNSAEPIEKVTPTNVPRQNDVPKEKTCLPEVKAKPKVQNKGAEKTQSKIPTNGANVEKFVNDVFDIMSPLFLSEVSKKLNVKQEELSSIFDGFKEQATIDLESVTTSLKNAAYTAGFEAGFETMLNSGLKGQASRK

SEQ ID NO: 5309 - protein, 127 aa, Lotus berthelotii
RVRLSIEIARKFFDLQDMLGFDKASNTLEWLFNKSKRAMKDLARSKNSNSGGGGGDNDDNTNNKSFSSEEDEDCEVVSSNLQQDQEQRLDSNLNKGGGAEKEMLNKLKRAQKEPSCARAKIKESREK

SEQ ID NO: 5310 - protein, 95 aa, Indigofera pendula
RVRLSIEIARKFFDLQDMLGFDKASNTLDWLFSKSNKAIKELTGGKINTSSSDVDGVASLSFSSSAEEEVISMEDNSSSQEIRQSKKKKKKMLEK

SEQ ID NO: 5311 - protein, 94 aa, Indigofera pendula
RVRSSIEIARKFFDLQDMLGFDKACNTLDWLFSKSNKAIKELTGGKINTSSSDVDGVASLSFSSSAEEEVISMEDNSSSQEIRQSKKKKKMLEK

SEQ ID NO: 5312 - protein, 192 aa, Vitis vinifera
METSENIATSIRKIRKRKFSEEQIRSLEFLFESEARPEAQLKQKVASELGLHPRQVAIWFQNKRARSKSKQIEQDYAVLKASYDNLALQFESLEKENQNLAIQLQRLRDGLEKPRGKEDEESEIGYTNSETKERYNPVLQGRIEYFAEDTHTPKMEEQTNSSLTSSADLGIFKSSCFQDQSNCSSQWWELWS

SEQ ID NO: 5313 - protein, 100 aa, Indigofera pendula
RVRLSSEIARKFFDLQDMLEFDKPSNTLEWLFTKSENAIKELARSKNSSCSPCEPNGVEYSNQNKSLVGSGEASKGRNKLKWGQREDVCVQITKKESRER

SEQ ID NO: 5314 - protein, 188 aa, Triticum aestivum
ISKVNRALGKIRAIESVDCSSKPTAAASSTSHRAPAPHLPCLSSALGEDTSSQGSSQDPPPLTKTTMRKSLLWRSNGAEGELVTIKANYRGDIIRFRVPCSAGVAAVKEEVAKRLGLDAGTFDVKYLDDDHEWVLLSCDADFQECLDVAPGLPASSTMAGGAGAVSPVVRLMVQEVADNHRSSCGSSD

SEQ ID NO: 5315 - protein, 175 aa, Oryza sativa
  misc_feature (41)..(41): Xaa can be any naturally occurring amino acid
  misc_feature (69)..(69): Xaa can be any naturally occurring amino acid
  misc_feature (97)..(97): Xaa can be any naturally occurring amino acid
MAAGEEVMDRSTSAEDGYCSAGTDSPRAESVDEQGAAEESXPRGGQKRELPSPSAFARRPPLPPAAKRXRRSVEKRVVSVPIAECGDRPKGAGEGPXPSDSWAWRKYGQKPIKGSPYPRGYYRCSSSKGCPARKQVERSRADPTVLLVTYSFEHNHPWPQPMSSSCHASMSSLGR

SEQ ID NO: 5316 - protein, 159 aa, Arabidopsis halleri subsp. gemmifera
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKTSSEITPPPSKPRGKTTALCRHCSSLLPQLLLVIINKKMSTRI

SEQ ID NO: 5317 - protein, 228 aa, Arabidopsis halleri subsp. gemmifera
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDGSLPSLFITAATTSSRYHQQENVYENIAKSFDGVVSASYEDKPKQELAQNDVLMATTNDPSHYYGNNALWVHDDDFELSSFVMMNFASGDIEYCL

SEQ ID NO: 5318 - protein, 607 aa, Physcomitrella patens subsp. patens
MGSPVDLTLGCSTQAPSSNGYYNHQNEPTHSENYLESLREVEERVRSLEEERRKVEGFKRELPLCIQLLEDAIKTWKVKLVNGKHLPLQLRSGSMDSGRNQHVMPSSPGSRPTLEDFMPFKRRWEQRDQPSESSDVEEEVRGSKRPAWLTEAPLWRQSSGCSEREGKEVQEHSEFGISEREQSSITSSQMLLSAKQRPAGAFLPFIRDQPGASSFLSRPTPRTVASAADLSLSLGERTTTPSSRNLRPSDSEVGSIDAGLQTPEVQIPKDIGVMSNGTSGAGSSSGGGNPTRKSRRCWSPELHRRFVSALHQLGGSQSRTSPPSSLNDDSNPNHLYSYDTNEQHPLLNLYRCTDGCLEIRSRLVFLQFLCVGILLAFCSGVYVGFELHKFNFTDTGCGCAVATPKQIRELMKVDGLTNDEVKSHLQKYRLHTRRPSSSPQSGGMGQSPQLVVLGGIWVPPQYAASGSQPSPGFYNPSAAHSPQPNQFCPTSLPQGYSCISNSTQGAQLEMHREPIFEPPRQAGTSQSQSSPQGPLQVTSQLSGATQGPSSAAYHDESAGEEDAKSESASWKCDNPKGEELKKSNSNQGSGDGQSRAHVSEEDVNQAD

SEQ ID NO: 5319 - protein, 267 aa, Oryza sativa Japonica Group
SDEDTLLSNLVEKLGPRNWTLIARGIPGRSGKSCRLRWCNQLDPQVKRKPFTEEEDRIIMAAHAIHGNKWAAIAKLLVGRTDNAIKNHWNSTLRRRHCTGGRCTQGGVMKRAIPERPRSVSEEPWPLGNLSSLNVREAMEAPAQTVSESYVGAWQIGDQSCKTEVVDPPYLARPVAKVGAFKPYNVGPAQSSQKEMLSFATKFDSNLHPFKPENGVCKFVDPTSFAAEVPNKCGHGCCSSHGQLRKNSLLGPEFNEFEDHPPISDSS

SEQ ID NO: 5320 - protein, 453 aa, Oryza sativa Indica Group
MSCSSEKAAGAVGGKAARACDSCLRRRARWYCAADDAFLCQGCDTSVHSANPLARRHERLRLRVSSPPPLTARASVEEEAAAAVGTTTTTTSKREGGVTPAWSKRKARTRRPQVKSVGQLLSRRLVVPEMAVESSDERKADEDGAHEELEGQLLYRVPVFDPSLTEFCSPPPIDDAAAASSSCFKEDAADGAVEDAKYPAAAASSPVQQLPDSFVNFEPTDAELREFAADMEALLGQGLDDSNELQDSFYMETLGLITPPVEESSRVKMELDGGVASSSRVSLPSCRAHPKPEDVESADVLDIDFNCTSPDEQKSSASNGAAADSQFFHRSLDLRLNYEAIIESWGNSPWTDGRPPHGQLDDFWPNDHHYSVRVVGAGGGGHGAEVGMMTVRPRMDGPGREARVTRYREKRRTRLFSKKIRYEVRKLNAEKRPRMKGRFVKRPSAAAAPCAVT

SEQ ID NO: 5321 - protein, 196 aa, Theobroma chocoense
CPVKKKVERSFDGQIAEIVYKGEHNHSKPQPPKRNSSGTQGLGFTSDGTGQDTNNSLWSNNPNERNEGSEGRVENQNEVRLSAPPSYQGKAVLSYEHATTGAVNAGVTSENSIGLSGECEERSKEGEDDEPRSKRRKSENQSSEVGTSGEGVQEPRVVVQSCTESEIMGDGFRWRKYGQKVVKGNPYPRSYYRCTS

SEQ ID NO: 5322 - protein, 376 aa, Zea mays
  misc_feature (60)..(60): Xaa can be any naturally occurring amino acid
MGSSGADTPSKEQQPPATSGAAIPPVYPDWSSFQAYPPIPPHGFFPSPVASSPQGHPFMXGAQAMIPPYGTPPPYVMYPPGVYAHPSMPPGAHPFTPYAITSPNGNADATGTTVAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSGDDSQKKGN

SEQ ID NO: 5323 - protein, 235 aa, Arabidopsis thaliana
MSLEIDAKAVSALLLGQGCANNLKTLLKNHETGSVSTEPLINSILDSFSFALSSQNIPRHVSQRSSKKKMCGIQGMEDSPTPAHIDGFIWRKYGQKTIKTSPHQRWYYRCAYAKDQNCDATKRVQKIQDNPPVYRNTYVGQHACEAPAYAVNNGGTYGSKMIKFDYVIPESVMPQPLSIDSQEITMEDKDTDDHILNYINEHLMEDEAYDVFPDVLGERCCFGLEPFPGLNINKS

SEQ ID NO: 5324 - protein, 196 aa, Theobroma gileri
CPVKKKVERSFDGQIAEIVYKGEHNHSKPQPPKRNSLGTQGLGFTSDGTGQDTNNSLSSNNPNERNEGSEGRVENQNEVGLSAPPSYQGKAVLSYEHVSTGAVNAGVTSENSIGLSGECEERSKEGEDDEPRSKRRKSENQSSEVGTSGEGIQEPRVVVQSCTDSEIMGDGFRWRKYGQKVVKGNPYPRSYYRCTS

SEQ ID NO: 5325 - protein, 196 aa, Theobroma grandiflorum
CPVKKKVERSFDGQIAEIVYKGEHNHSKPQPPKRNSSGTQGLGFTSDGTGQDTNNSLWSNNPNERNEGSEGRVENQNEVGLSAPPSYQGKAVLSYEHATTGAVNAGVTSENSIGLSGECEERSKEGEDDEPRSKRRKSENQSSEVGTSGEGVQEPRVVVQSCTESEIMGDGFRWRKYGQKVVKGNPYPRSYYRCTS

SEQ ID NO: 5326 - protein, 237 aa, Brachypodium distachyon
ISVLCDAEVAVVVFSPMGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAASRQQQQQQVQWEQHAHTQAQAHAQAQAQTQAQAQTSSSSSSMMRDHQQARVPQQNICSYPPATMGGESSSVAAPGQGQIRIGGLPPWMLSPS

SEQ ID NO: 5327 - protein, 396 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLELRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTALDLNTHDENYGTTRPKQFDLNGFSWN

SEQ ID NO: 5328 - protein, 76 aa, Physcomitrella patens subsp. patens
KRLREPRYAIKTRTDMDVLDDGFKWRKYGQKAVKNSPHPRNYYRCTTPLCPVRKRVERSKEDAGLVITTYEGTHSH

SEQ ID NO: 5329 - protein, 423 aa, Oryza sativa Japonica Group
MASSSDEQPKPPEPPAAAAVAGTAVATAAAAVPTHAEWAASLQAYYAAAGHPYAWPAQHLMAAAAAGAPYGAPVPFPMYHPGAAAAYYAHASMAAGVPYPTAEAMAAAAAAAAGAVPEGKGKGKGAAASPEKGSSAAPSGDDASRSGDSGSEESSDTRDDDTDHKDSSAPKKRKSGNTSAEGEPSQATLVPYAAVESPYPLKGRSASKLPVSAPGRAALPNATPNLNIGIDLWSTPPALAVPAGQGEASPGLALARRDGVAHLDERELKRERRKQSNRESARRSRLRKQQECEELARKVAELTTENSALRSELDQLKKACEDMEAENTRLMVSTWHSTHTLPLVETGNATSFHITQFLWIILNFMKGDKAQYKGPTVTTTLGMSIDSSKTQHHDDEGQLHKNTNNNSNGNYVGGSHKPEANSR

SEQ ID NO: 5330 - protein, 300 aa, Antirrhinum majus
MEQPNNDGNNGGSCYRPQLPNQSPPANGVPNSTTTNSTHSPPNESVKRKRGRPRKYGTPEQAAAAKRLSAPKKRDSASGVASVSSASSKKSPLAALGNMGQSFSPHIITVAAGEDVGQKIMMFVQQSKREICVISASGSVSSASLRQQASSGGSVTYEGRFDILSLSGSFIHAEFGGRTGGLSVCLSSSDGQIIGGGVGGPLTAAATIQVIVGTFVVETKKDANVEAAASGKSPSPNGGASAPGLSFRSPADSGIQMGGGGNPFLIQNRTMHMTPMEWIGSADHGMHQSPENGDYDHIPD

SEQ ID NO: 5331 - protein, 241 aa, Brachypodium distachyon
ISVLCDGEVAVVVFSPMGKLYEYATDSSMDKILERYERYSYAEKALISAESESEGNWCHEYRKLKAKIETIQKCHKHLMGEDLDSLNLKELQQLEQQLESSLKHIRSRKSHLMMESISELEKKERSLQEENKHLQKKLVERQKAASRQQQQQQQQLQWEQHAHTQAQVQAQAQTQAQAQTSSSSSSFMMRDHQQAHVPQQNICSYPPATMGGESSSVAAPGQGQIRIGGLPPWMLSPSTLD

SEQ ID NO: 5332 - protein, 142 aa, Clitoria sp. Pennington 990
RVRLSIEIARKFFDLQDMLGFDKASNTLEWLFNKSKRAIKELARSKNSNNNNNSEELGGKSFSSSSECDDDDCEEVVSEIKQQQQQQLITTCDAAAASASNLQKQGLDSNDHNKSLVAARERTNKMKRAQKEPAKMKESREK

SEQ ID NO: 5333 - protein, 264 aa, Solanum lycopersicum
MNSQIFSTGFSGYGMEQQGSIGLNQLTPIQIQQIQAQINFQNQQQQQQQQMMLQTAHHASTMNFLAPKPVPMKQSGSPPKPTKLYRGVRQRHWGKWVAEIRLPKNRTRLWLGTFDTAEEAALAYDKAAYMLRGDFARLNFPQLRHNGNLIGGDFGEYNPLHSSVDAKLKDICQSLAQGKSIDSKKKKTKGLSAEKAAVVKMEEEESKTAEVGSESDGSHSGSGGSSPVTELIFPEFTEEEPTWDMSENFLLQKYPSHEIDWASL

SEQ ID NO: 5334 - protein, 97 aa, Clitoria sp. Pennington 990
RVRLSIDIARKFFDLQDMLGFDKASNTLEWLFTKSKKAIKELTRSNKHSVVDSFSSSSEGEVVSMIQQQQMVDLEEKLKEPAFRDGKAKILKETREK

SEQ ID NO: 5335 - protein, 110 aa, Clitoria sp. Pennington 990
RVRLSSEIARKFFDLQDMLEFDKPSNTLEWLFTKSENAIKELARSKHSCSSTSGGDKCSCDPSVDSSNNNKSFVGGGGGDSSKGRNNNNKLKWAQRDDACVLTKKESRER

SEQ ID NO: 5336 - protein, 258 aa, Theobroma cacao
KQVKGSEYPRSYYKCTHPNCQVKKKVERSLDGQITEIIYKGAHNHPKPLPCRRPSIGSTLSSDEMSEIAEGGGTCVKVEGGLIWRNAQAGSRDIKLGSDWRADGLERTSSTSVVTDLSDPLSTAQGKSFGAFELAETPEFSSTLASHDDDNDDRATQGSISLCDDAANDDESESKRRKTESCLTEMNATSGALREPRVVVQIESDVDILDDGYRWRKYGQKVVKGNPNPRSYYKCTTPGCPVRKHVERASHNLKCVLT

SEQ ID NO: 5337 - protein, 358 aa, Raphanus sativus
QSDKPEQVQAPPPPPEQSNVHVYHHDWAAMQAYYGPRVAIPPQYYNSNGHAPAPPPPYIWGSPSPMMAPYGTPYPPFCPPGGVYAHPGLQMGSQPQGPVSQATPVVTTTPLNLEAPANSPGNTDQGFMKKLIEFDGLAMSISNNKAGSAEHSSGPRNSQSSENDDSSNGSDGNTTGGEQSRKKRSREGSPNDDGKPSSQIVPLLRDENEKPAVTMGTPVMPTAMDFPQPCHGAPHEVWNEKEVKREKRKQSNRESARRSRLRKQAETEELSLKVDALVAENMTLRSKLAQLNDESEKLRLENEASLAQLKATQTQAAGKTENLISRVDNNNNSVSGSSKNVEQQLLNVSLRTDSVAAS

SEQ ID NO: 5338 - protein, 296 aa, Triticum aestivum
  misc_feature (109)..(109): Xaa can be any naturally occurring amino acid
MSFHYPDHGLAMDAAAAAAAAASSPNPSFSPGGGGGEREKAAIAAHPLYERLLEAHVACLRVATPVDQLPRIDAQIAARPPPLAAAAAAGGPSGGEELDLFMTHYVLLXCSFKEQLQQHVRVHAMEAVMGCWELEQSLQSLTGASPGEGTGATMSDDEDNQVDSETNMFDGNDGSDGMGFGPLILTEGERSLIERVRHELKSELKQGYKEKLVDIREEIMRKRRAGKLPGDTAATLKAWWQAHSKWPYPTEDDKARLVQETGLQLKQINNWFINQRKRNWHSSNTASSSEKTKKKR

SEQ ID NO: 5339 - protein, 320 aa, Solanum lycopersicum
MDDEIMYGFNSTRDDYADKALMSPENLMMQTEYNNFHNYTNSSIMFGSDPIQLSSEQTLQNNIYRGNCCGGSGSGGDNNNNNDEDGSNIIKAKILSHPYYPKLLNAYIDCQKVGAPASIVNLLEEIRQQNDFRKPNATCLCIGADPELDEFMETYCDILLKYKSDLSRPFDEATTFLNNIEMQLGNLCKDDDEEEEEELSCGDASSSMRRSEDNELKDRLLRKFGSHLSSLKLEFSKKKKKGKLPKEAREMLLAWWYDHFRWPYSTEADKNSLAESTGLDPKQINNWFINQRKRHWKPSENMQLAVMDNLSAQFFSSDVD

SEQ ID NO: 5340 - protein, 176 aa, Capsicum annuum
  misc_feature (15)..(16): Xaa can be any naturally occurring amino acid
MEGTSSIDQESTTSXXLSIAPAASSSMVVKQQPSMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGIY

SEQ ID NO: 5341 - protein, 310 aa, Solanum lycopersicum
MQQEEGGLGLMGSSNTSGLGGGDISSMMISSEDHHNRNLNHYNQLKSEIATHPLYEQLLSAHVACLRVRTPIDQLPLIDAQLTQSHNLLRSYASSQQQQQQHSLSHHERQELDNFLAQYLLVLCSFKEQLQQHVRVHAVEAVMACREIEQNLQLLTGATLGEGTGATMSDDEDELQMDFSLDVSGGDAHDLMGMGFGLPTESERSLMERVRQELKIELKQGFRSRIEDVREEILRKRRAGKLPGDTTTVLKNWWQQHSKWPYPTEDDKAKLVEETGLQLKQINNWFINQRKRNWHSNSQSVTSLKSKRKR

SEQ ID NO: 5342 - protein, 321 aa, Eucalyptus gunnii
MGMAMGIKEKASSNPHNHKLRKGLWSPEEDEKLMRYMLTNGQGCWSDIARNAGLQRCGKSCRLRWINYLRPDLKRGAFSPQEEELIVHLHNILGNRWSQIAARLPGRTDNEIKNFWNSTLKKRLKMNSATSSSNESDLSNPQDIAAGIMPSFHAQYDVLATCMDSSPAPFPPMDNISAPNQFDPFPTLNNRCDTWEGVGFFTFPSGIAPVSMGDDSSYLNLEHAKVGLLGSEFSVPPLASSTTTTEENNYRSIGCGMDGKGENSFSNNNDSCFSNTTTASFKAEDDMSGFGNNLQAANLRIGEWDLEGLMDDLPSFPFLDF

SEQ ID NO: 5343 - protein, 364 aa, Hordeum vulgare subsp. vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHHSSLLAAYLDCQKVGAPPEVSARLTAVAQDLELRQRTALGGLGTATEPELDQFMEAYHEMLVKYREELTRPLQEAMEFLRRVETQLNSLSISVRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 5344 - protein, 255 aa, Eucalyptus gunnii
  misc_feature (214)..(214): Xaa can be any naturally occurring amino acid
MGRSPCCEKAHTNKGAWTKEEDDKLIAYIRAHGEGCWRSLPKAAGLLRCGKSCRLRWINYLRPDLKRGNFTEEEDEIIIKLHSLLGNKWSLIAGRLPGRTDNEIKNYWNTHIRRKLLNRGIDPATHRLINEPAQDHHDEPTISFAANSKEIKEMKNNAELNFMCNLEESADVASSARERCPDLNLELGISPPSHQLHQPEPLLRFTGRKSDLCXECNLGLKNSQNCRCSVGVIESETSVGYDFLGLKASVLDYRS

SEQ ID NO: 5345 - protein, 204 aa, Zea mays
  misc_feature (90)..(90): Xaa can be any naturally occurring amino acid
MASTSSSTPAAEVEERGRKRKRAAGAAPTQPSEWRTRREHEIYSSRLLEAIRLVRAGPSSAAAAKAAPTRSRAVREAADRALAVAARGRXTHWSRAILAAHRRRLQAAHRARLRAPASPPPRHGAPSASAAKGAPAPPPVARKAMGLGRLVPGCRKLSFPTLLAETTDYIAALQMQVRAMTALAEALSAVSATSSSGAGSSSPP

SEQ ID NO: 5346 - protein, 195 aa, Theobroma mammosum
CPVKKKVERSFDGQIAEIVYKGEHNHSKPQPPKRNSSGTQGLGFTSDGTGQDTNNSLWSNNPNERNEGSEGRVENQNEVRLSAPPSYQGKAVLSYEHATTGAVNAGVTSENSIGLSGECEERSKEGEDEPRSKRRKSENQSSEVGTSGDGVQEPRVVVQSCTESEIMGDGFRWRKYGQKVVKGNPYPRSYYRCTS

SEQ ID NO: 5347 - protein, 196 aa, Theobroma microcarpum
CPVKKKVERSFDGQIAEIVYKGEHNHSKPQPPKRNSSGTQGLGFTSDGTGQDTNNSLWSNNPNERNEGSEGRVENQNEVGLSAPPSYQGKAVLSYEHVTTGAVNAGVTSENSIGLSGECEERSKEGEDDEPRSKRRKSENQSSEVGTSGEGIQEPRVVVQSCTDSEIMGDGFRWRKYGQKVVKGNPYPRSYYRCTS

SEQ ID NO: 5348 - protein, 355 aa, Physcomitrella patens subsp. patens
MPLANVLIAQLNQVVSIYGDPMQRLAAYMVEGLVARVAASGKGIYRSLKCKDPPTRDLLSAMQILYEVCPYFKFGYMAANGSIAEAFQNESRVHIIDFQIAQGTQWTTLIQALAARPGGPPHLRITGIDDPMPGPNSNAGVEMVGKRLAKLAEAVGVPFDFHPVAKKGPEVEAWMLERQPGEALAVNFALHLHHMPDESVCTSNPRDRILHMVKALNPKVVTLVEQESNTNTAPFFPRFLEAMNYYAAIFESLDITLARESKERVNVEQQCLARDIVNIIACEGIDRVERHEMMGKWRARLTMAGFRPYPLSQTVNNTIKTLLESYSDKYRLKDEGGALYLGWKNRSLIVSSAWQ

SEQ ID NO: 5349 - protein, 876 aa, Chlamydomonas reinhardtii
MQRIGPGSWQSQPSHDAPLGRDYPLHGFSLPPDEGPHRPGPGAGHFHHPHQHHGHGTDSHLGVRHAPLKAAAGASGRGPSQALHAFPNALLEYHQKQEPMSDDDDNDGDGEGAGRGSGGPNSASGAGNVGDALDDALPLSELQQVYHLPSKEAARQLGVSLSRLKRSCRAHNVLRWPHRKLASLHNLRDTIRNDRNMKPPDKERIQAQISTELAAVIANPDHTIDTRLDEIRQAKYKLKYYHKTKHIHAAASAARRKRASTGADGPEPSANSAGGSGSGAGGAAGGGQGGYGAASVALTLPGGGIDVTSPAASMLTGGGGGPMPSASVITTATGVTTTEVMGSGGGPRLSYTSGAGASGLGGGGLVGGGGGARLSGSGLAWPPQAPGGNGGGGGGGGGTPWQPSSGSWQQQPQPWSGVSAFSGGGGGGFGGGHGGRGGVQGNDIVALGDTGGGNGGDGGRGGGGDPMSRAGSLTSGAPLPQLPPGGRYTGGSNSSVQLPHPPPLSLGPHFGSAPSQSQSHTGALLQLPPALPPTVQPPQHSQHQQQHYPPIHSGVRPHPHSPQQPSLQQQQQQQQYAAGGGSGSGMRLQRSLHGDASGGGPASGDFGGGGGMYGGANNVLRRPSYGVSDETPGTGSGFGFQHQAQQEQQHNHNQHMHMQNQQQQHSPPASVVYGHSGGRPHSQPHPHQDPSLQQYPEGPASGPSSGPLSGQPWHQQPQMQQQQQQMQAPNQTQNQPSLLQLHQQQQQQQHAAAAAAAANAAAVARHMSGDLDTAMEVERAAGAGAGTAGASGAGASTMSHGVIDTACAPVGQQGQGQEAAAAQVARHTSASGAAPAAGGRVGQWSTAPQLNRQVCRREAGFSGLIIWEGLLLASFE

SEQ ID NO: 5350 - protein, 173 aa, Triticum aestivum
MESDKMVQVEAAADPEERTASGDPKACDDCNTTKTPLWRGGPNGPKSLCNACGIRYRKRRRVAMGLDPEAKRKPKRDDAIKAAAEAAQASSKEEEEEEEVKAKAGDEKAGEEKASKKTKARTTHTVELHMVGFAKDAVLKQQRRRRRRKPSCLGEEERAAILLMSLSSGVIYA

SEQ ID NO: 5351 - protein, 192 aa, Theobroma speciosum
  misc_feature (5)..(5): Xaa can be any naturally occurring amino acid
CPVKXKVERSFDGQIAEIVYKGEHNHSKPQPPKRNPSGTQGLGFTSDGTGQDTNNSLWSNNPNERNEGSEGRVENQNEVGLSAPPSYQGKAVLSYEHVTTGAVNAGVTSENSIGLSGECEERSKEGEDDEPRSKRRKSENQSSEVGTSGEGIQEPRVVVQSCTDSEIMGDGFRWRKYGQKVVKGNPYPRSYY

SEQ ID NO: 5352 - protein, 192 aa, Avena strigosa
YEFATDSCMDKILERYERYSYAEKVLISTESEIQGNWCHEYRKLKAKVETIQKCQKHLMGEDLESLNLKELQQLEQQLESSLKHIRSRKSQLMHESISELQKKERSLLEENKILQKELVEKQKAHTQQAQWEQTQPQTSSSSSSFMIREAPPATNISAGNQPAAAGERPEEAAVQPQARSGLPPWMVSHING

SEQ ID NO: 5353 - protein, 259 aa, Glycine max
  misc_feature (37)..(37): Xaa can be any naturally occurring amino acid
MVQQEVRKGPWTEQEDFKLVSFVGLFGDRRWDFIAKXLNRTGKSCRLRWVNYLHPGLKRGKMTPQEERLVLELHSKWGNRWSRIARKLPGRTDNEIKNYWRTLMRKKAQEKKRGEAASSSPTPSSVDSSISSNNHAVDPHASKKAGEESFYDTGGDNGVIASTQDQGQKGEQGLFSMDDIWKDIDNMSEENNTTLQPVSVYDGHSEEGCNFSCPPQVPSPSSWEYSSDPLWVMDEESLFCPLSEPYFSCYAQGTVFLTG

SEQ ID NO: 5354 - protein, 363 aa, Triticum aestivum
MEEIGHHFGLGATAHGQHHSQLPWGSSPLSAVIAPPPQQQQQQQQSAGYLAHSPLSLNTAPPSGSHGGGSGCSNPVLQLANGSLLEACAKAAKEPSSSSYAADVEAIKAKIISHPHYSSLLAAYLDCQKVGAPPEVLARLTAVAQDLELRQRTALGSLGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 5355 - protein, 210 aa, Avena sativa
ISVLCDAEVGLIIFSTKGKLYEFATDSCMDKILERYERYSYAEKVLISTESEIQGNWCHEYRKLKAKVETIQKCQKHLMGDDLESLNLKELQQLEQQLESSLKHIRSRKSQLMHESISELQKKERSLLEENKILQKELVEKQKAHTQQAQWEQTHPQTSSSSSSFMIREAPPATNTSAGNQPAAAGERSEEAAEQPQARSGLPPWMLSPL

SEQ ID NO: 5356 - protein, 425 aa, Oryza sativa Japonica Group
MDMEHELRGGGVGAAAHGHGSICFSGGPVLVDGRRIQQLLLHCAAALESNDVTLAQQAMWVLNNIASSQGDPSQRLTSWLLRALVARACRLCASAPAGAPVEFLERGRAPPWGRAMSVTELADYVDLTPWHRFGFTASNAAILRAVAGASAVHVVDLSVTHCMQWPTLIDVLSKRPGGAPAIRITVPSVRPAVPPLLAVSSSELGARLAIFAKSKGVQLEFNVVESATTTSPKKTSTTLCQELASVLSDPPSLGLRDGEAVVVNCQSWLRHVAPDTRDLFLDTVRALNPCLLTVTDEDADLGSPSLASRMAGCFDFHWILLDALDMSAPKDSPRRLEQEAAVGRKIESVIGEEDGAERSEPGARLAERMSRKGFAGVVFDEEAAAEVRRLLSEHATGWGVKREDDMLVLTWKGHAAVFTGAWTPN

SEQ ID NO: 5357 - protein, 192 aa, Zea mays
LAPEIPYFREVIVMATTCDMCGYRNSELKPGGEIPAKGKKITLRVQNAQDLTRDVIKSDSASVKVPELELELSCGTLGGMVTTVEGLIVKICEALERIHGFQLGDSTLEWKKKKWDDFKERLSKLLSLQEAWTLIIDDGLAASFVAPATDSLEDDSQLTIEEYQRSWEQNEELGLNDMDTSSADAAYNTTNT

SEQ ID NO: 5358 - protein, 210 aa, Avena sativa
ISVLCDADVGLIILSTKGKLYEFATDSCMDKILERYERYSYAEKVLISTESEIQGNWCHEYRKLKAKVETIQKCQKHLMGEDLESLNLKELQQLEQQLESSLKHIRSRKSQLMHESISELQKKERSLLEENKILQKELVEKQKAHTQQGQWEQTQPQTSSSSSSFMIREVPPATNIGAGNQTAAAGERPGEAATQPQARPGFPPWMLSPL

SEQ ID NO: 5359 - protein, 131 aa, Acosmium subelegans
RVRLSIEIARKFFDLQDMLGFDKASNTLEWLFNKSKKAIKELARSKNSFSEGAKSFSSSSDCEDCEVVSWSKEQVVTTDHIPNLQQGLDLTDNKSLMGGGGDGDAVKERKLKRAEKEPPGVRAKMKESREK

SEQ ID NO: 5360 - protein, 272 aa, Gossypium hirsutum
MDGGGSSSNSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAGEASESPTKSTTAVKHDPSTSQPDTEPDSGMEDGFACLTEDSILTTGDEFAWFGEMETTSSTVLESSLFSERDNSEADDTAVISPMREEDESLFADLGELPECSFVFRHQRNVGPQVGIC

SEQ ID NO: 5361 - protein, 316 aa, Zea mays
MATPAAASKMSKKLQGGGDRSSGSSSRGSGNSDKQQVPAAAMRKGPWTEEEDAQLVWFVRLFGERRWDFLAKVSGLRRTGKSCRLRWVNYLHPGLRRGRITADEERLILQLHAQWGSRWSRIARSLPGRTDNEIKNFWRTRARKQKAAAQQQQQQQDSRSSKTATASAFSGSASSVTTTTSSCSGSPSPTSRGCGTATSSSALTESALRQSGGEDEDAELDEASTTTTTTASQRQHQDDDHQQQHQECYASDHFWNDIAAAEAAIYMLIDGGWTGSGPGHPAADPPSSPAWEYCSDYSLWRIDDDEYYEKMLDSSS

SEQ ID NO: 5362 - protein, 95 aa, Acosmium subelegans
RVRLSIDIARKFFDLQDMLGFDKASNTLEWLFNKSKKAIEELARSKNSSSGAANSFSSSSECEVVSVINQDIADATPEGVVVDSKERKLKREREK

SEQ ID NO: 5363 - protein, 229 aa, Avena sativa
ISVLCDAEVAVFVFSPEGKLYEYATDSSMDKILERYECYSYAEKALISAESESEGNWCHEYRKLKAKIETIQKCHKHLMGEDLDSLNLKEPQQLEQQLESSLKHIRSRKGHLMMESIFELQKKERSLQEENKALQKELVERQKAARQQQQQVQWDHQTQTQQAHQNQPQAQTSSSSSSFMIRDHQAHAPQNICYPPVTMGGEAVAAAPGQQGQLRIGGLPPWMLSHLNA

SEQ ID NO: 5364 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 5365 - protein, 104 aa, Acosmium subelegans
RVRLSSEVARKFFDLQDMLEFDKPSNTLEWLFTKSENAIKELARSKHSKCCEGDKCSYDHPHGLDSSNEKSFVGNSGDASKGRKLKWAEREDVCVQTKKESREK

SEQ ID NO: 5366 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 5367 - protein, 140 aa, Picea glauca
VEDGSGGETDFQEVDRHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 5368 - protein, 295 aa, Zea mays
MEDLYSIHPGISRVVGGAASEASVAGAGAGGPSPSDLTELMKAQIASHPRYPSLLSAYIECRKVGAHPHVTSLLEEVSRERRPDAGAGEIGVDPELDEFMDAYCRVLVRYKEELTRPFDEAASFLSSIQAQLSDLCSGGSSPAATATHSDDMMGSSEDEQCSGDTDVPDMGQEHSSHLGDHELKEMLLKKYSGCLSRLRSEFLKKRKKGKLPKDARTVLLEWWNTHYRWPYPTEEDKVRLAAMTGLDPKQINNWFINQRKRHWKPSEDMRFALMEGVAGGSSGTTLYFDTGTIGP

SEQ ID NO: 5369 - protein, 176 aa, Panicum miliaceum
KRRNGLLKKAYELSVLCDAEVALIIFSSRGRLFEFSTSSCIYKTLERYRSCSFASEASAPPEAELNNYQEYLKLKTRIEFLQTTQRNLLGEDLGPLSIKELEQLENQIEISLKHIRSSKNQQMLDQLFELKRKEQQLQDSNKDLRRKIQEIGEENVLRLTCQDLGPTGSSGHPDDA

SEQ ID NO: 5370 - protein, 520 aa, Vitis vinifera
MWDLNDSPDQRRDDESEGCSSQKTSVDSIDDKGKRVGSVSNENSSSSAVVIEDGSDEEDGERGQRKRSSKIFGFSVTHEDEGEPPVTRQFFPMEESEMGTTSCGGAAAFPRAHWVGVKFCQSEPLNTAGVATAKSLEASQPLKKSRRGPRSRSSQYRGVTFYRRTGRWESHICAYDRAAIKFRGVEADINFSLEDYEEDLKQMGNLTKEEFVHVLRRQSTGFPRGSSKYRGVTLHKCGRWEARMGQFLGKKYVYLGLFDTEIEAARAYDKAAIKCNGKEAVTNFDPSIYENELNSSGNAADHNLDLSLGGSASKQNNLELGDDSQVVTMDQHSVGMSFEADWRSRGFRPKQEACKSDGDALRRNGYNEMETMQLLSHTHLQSPAALKPGEMYRYGQFRRAGETQMLHILPPQLSSPNYQIQFPSSSNGGRIAVNGGDLSLATNHQQWQSGVDRERAWGLKLGIVFWEISLDGDELSLSMMSFESVLSAKSSQTWLLWREGPIILTQSLKGRLEMESPPKG

SEQ ID NO: 5371 - protein, 137 aa, Setaria italica
GKKYIYLGLFDSEVEAARAYDRAALRFNGREAVTNFEPSSYNAGDSLPDTESEAIVDADAVDLDLRISQPNVQDTKRDNIIVGLQPTYDSPESSNTMTSQPMSSSSLWPMYHQSPAVPSHHQRLYSSACPGFFPNHQ

SEQ ID NO: 5372 - protein, 374 aa, Oryza sativa
  misc_feature (36)..(36): Xaa can be any naturally occurring amino acid
MEATPISVKPPSPVAAAPPPPPVQVPVPPPPPPPLXPAAAAVEPLPPQPVAVVVAEAEPCSMNQLALTPTPKRQKVEESADGNGCKHCACKKSRCLKLYCPCFAGGGYSSEKCGCQPCFNKALYAETVQTTRKVLLSRQKRMSLKINRRSEANAEAVEDAHHSSSSTPPRRGCNCKKSSCLKKYCDCYQDGTGCSLFCRCEDCRNPFGKNEGIMAEESKRFLYTGADLDHSEDEQDFIVERSPRLQSPISKESSFQQTPPHIRATNRDTHMFPQAISQWQPRSWHCSKRQSNDRVIDDSGEYKNSNHDWQLAKPEDSYSISRCVQILNGMAELSQVEKSVAPDVFLQAGNREIFISLNGDVRALWLKRKIQNLT

SEQ ID NO: 5373 - protein, 502 aa, Physcomitrella patens subsp. patens
MAAPATEHHNNMIADVGDAAEALTADDGAPLHQIESLCMRCGENGMTRLLLTRIPHFREVVLMAFECPHCNERNNEVQFAGQLQPQGCAFTLTVPAGEPEVLNRQVVKSDVATIKVPELEFEVPPQSQRGTLSTIEGVLSKAVDELRTLQEERRKADPSIAEAIDAFLMKLNACAKGEQAFTFVIDDPSGNSYIENPYAPNSDPLLSTEYYDRTSEQQEALGFLAQSTSSTEPSEAIPEARAAASDHKRVKYAPAGTTRLPHGSVGAIAAHQAIAHGNSPEIAEALFKYSAPEEVMTFPSTCGACGVKAETRMFVTNIPYFKEVIVMASSCDVCGYKNSELKPGGRIPEKGKKIRLVIKSVRDLSRDVIKSDTASVEIPELELQLSPGTLGGLVTTVEGLLSNISESLKRVHGFSIGDSAEAWKKNRWQEFDSHLQKLLKVEEEFTLILDDALANSFIAPATDDFEADSQLSSEEYERTFEQNEDLGLNDMDTSAADGAYDN

SEQ ID NO: 5374 - protein, 180 aa, Coix lacryma-jobi
GKKYIYLGLFDSEVEAARAYDRAALRFNGREAVTNFEPSSYNAGDNNLPDTETEAIVDADAIDLDLRISQPNVQDPKRDSTLAGLQPTCDSPESSNTMASQPMSSSSPWPGYQQNPAVSSHHQLLYSSACHGIFPNHQVQERPMEQRPELGAQPFPTWAWQTQGTAHVPLHHSAASSGFS

SEQ ID NO: 5375 - protein, 196 aa, Theobroma velutinum
CPVKKKVERSFDGQIAEIVYKGEHNHSKPQPPKRNPSGTQGLGFTSDGTGQDTNNSLWSNNPNERNEGSEGRVENQNEVGLSAPPSYQGKAVLSYEHVTTGAVNAGVTSENSIGLSGECEERSKEGEDDEPRSKRRKSENQSSEVGTSGEGIQEPRVVVQSCTDSEIMGDGFRWRKYGQKVVKGNPYPRSYYRCTS

SEQ ID NO: 5376 - protein, 249 aa, Fragaria x ananassa
MGRGRVELKRIENKINRQVTFAKRRNGLLKKAYELSILCDAEVALIIFSNRGKLYEFCSSSSMLKTLERYQKCSYGAMEVQKPAKELEESSYREYLKLKTRCESLQQTQRNLLGEDLGPLNTKELEQLERQLESSLKHVRSTKTQHMIDLLSDLQSKEHMLIEANRDLKTKLDEIDSRTQLRQTWEHGHDHQTMLYGTQHAQTQGLMFQPLDCNPTLQIGYNAVVSQEMPAATPAHAQPVNGFIPGWML

SEQ ID NO: 5377 - protein, 250 aa, Zea mays
MVTVREETRKGPWTEQEDLQLVCTVRLFGERRWDFIAKVSGLNRTGKSCRLRWVNYLHPGLKRGRMSPHEERLILELHARWGNRWSRIARRLPGRTDNEIKNYWRTHMRKKAQERKRNMSPSSSSSSLSYQSGYPDTPSIIGVKGQELHGGSGCITSILKGTHPDMDGYPMDQIWMEIEAPEVPSEVGFVGGNENVCSSLATPLPPPTVWEYYPEVCWKLDDEIKMAPQFGYIVKELTPASDTIYIGSDY

SEQ ID NO: 5378 - protein, 267 aa, Vitis vinifera
  misc_feature (41)..(41): Xaa can be any naturally occurring amino acid
MEIPRSEPCLSETSSIISVSEAAPSLNTSMDSPKEGKQQEXQDRNQEELTNPDLVLDLSLSSRDLEQGSRPELNLINSFEMGSSQNQSEIPQGNEGEPRVFSCNYCQRKFYSSQALGGHQNAHKRERTLAKRGQRIGAASVAFGHPLPNPYRFSSMASLPLHGSFNRSLGIQAHSLIHKPSSLSSTLYGHQGWSRLPIDQQPAIGRLAPENYHVGSSSSSGGAARFETVRKFSRPASEGIGGYWWNNSNNLKMNQDELQKLDLSLKL

SEQ ID NO: 5379 - protein, 374 aa, Medicago truncatula
MEGSSNGSCSYVMGAFGENSGGLCPPMMMMPLVTSSHHNAHHPINSNNNNTNANNTTGLFLPIPNSTNNNNNHYTNCNNNTSSIMLQNNHQNTPGLGYYFMDNINNHGSSSSSSSSVKSKIMAHPHYHRLLEAYINCQKVGAPSEVVARLEEACATAVRMGGDAVGSGCLGEDPALDQFMEAYCEMLIKYEQELSKPLKEAMLFLQRIEVQFKNLTVSSSSDNIACSEGGDRNGSSEEDHVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLTNSYPMDLSNTML

SEQ ID NO: 5380 - protein, 521 aa, Glycine max
MSTGDRPKMHDQTGCFDPNTTGESVPSLKDNFPQTLPPSSPMVVVGNTTTNSINNSLEENLRLSVEELSCNHHNPQHQQDHVSTYASGVTATSIEIPLPQHLGLNMGNSYINNNNNMDNHLVQEVIDAFPYQQSTWDPTIVQELQDMAYANHTEQTQQQQQNEQQFQQFETQNCSQSYNNPSSILDPPYPSPDLLNLLHMPRCSASSLLTNPSICLTNPTQNTPNFQNPMAFLGDLPIRSENTSASSVLYDPLFHLNLPPQPPALRELFQSLPRGYSLPTNSRNGSLFGGGDEMEGDGSQLDMGVLEFNRVTLTPSVGKGRRGKATKHFATEKQRREQLNGKYKILRNLIPSPTKTDRASVVGDAIDYIRELIRTVNELKLLVEKKRYAKDRCKRPKTEEDAAESCNIKPFGDPDGGIRTSWLQRKSKDSEVDVRIIDDDVTIKLFQRKKINCLLFVSKVLDELQLELHHVAGGHVGEYCSFLFNSKIMEGSSVYASAIANRVIDVLDSQYAAAVPHTNSY

SEQ ID NO: 5381 - protein, 288 aa, Medicago truncatula
ARGNIMHNHHHQGGGGSPSSSNVEAEAIKAKIIAHPQYSSLLQAYMDCQKIGAPPEVVARLVASRQEFEARQRSSVNSRETSKDPELDQFMEAYYDMLVKYREELTRPIQEAMDFMRRIETQLNTLCNGPLRIFPDDKNEGVGSSEEDQENSGGETDQLPEIDPRAEDRELKNHLLKKYSGYLSSLKQELSKKKKKGKLPKEARQKLLNWWELHYKWPYPSESEKVALAESTGLDQKQINNWFINQRKRHWKPSEDMQFMVMDGLHPQSAALYMDGHYMADGPYRLGP

SEQ ID NO: 5382 - protein, 211 aa, Eleusine indica
ISVLCDAEVALIIFSTKGKLYEYSTDSCMDKILERYERYSYAEKVLISAESETQGNWCHEYRKLKAKVETIQKCQKHLMGEELETLNLKELQQLEQQLESSLKHIRSRKSQLMHESISELQRKERSLQEENKVLQKELAEKQKAHKQQGQWDHGQQPQTSSSSSSFMMREAPPTANISNYTASAGVRVDGAADQPQVRIGLPPWMLSPLSG

SEQ ID NO: 5383 - protein, 238 aa, Triticum aestivum
MVTVQDEMRKGPWTEQEDLQLVCTVRLFGDRRWDFVAKVSGLNRTGKSCRLRWVNYLHPGLKHGRMSPQEEHLIIELHARWGNRWSRIARRLPGRTDNEIKNYWRTHMRKKAQERKTDMSPSSSSSSFTYQSCLLETAPIIRMDGGSTHNGTTCFSSVLKSNQSVMDGYSMDQIWKEIEAPAMLPIDKKACSNLPCPVLPSPMGDRYCPPEVVWKMDNGDLKMLAPQFGYGNGERSCY

SEQ ID NO: 5384 - protein, 314 aa, Larrea tridentata
MAYPSWVDTSLDLNLNPLRASNEASPMKQEMEINFMQLGIETPVKQEMQAAELVKELNRVSAENKKLTHMLTGMCESYNTLKCQLEEYMSKSPEKESSPSKKRKSESGDNSGNVIGNGGNSESSTSDEESCKKPKEEAIKVKTSKIYVRTDKDDKSLLVKDGYQWRKYGQKVTRDNPCPRAYFKCSFAPSCPVKKKVQRSAEDQSLLIATYEGEHNHPQPSQIDVTSSSSRPVALSPLPGSACTGSSAVTATVELTKSKSCQNTIFRPKVETPDFKDYLVEQMAFSLTKDPNFTGAFAAAISGRINNQRPGGNW

SEQ ID NO: 5385 - protein, 457 aa, Arabidopsis thaliana
MDQRSLEAAAKSGNIDLLYELIHEDPYVLDKTDHVPFVNTPLHVAAVNGKTEFAMEMMNLKPSFARKLNADGLTPLHLAVEHGHFWLVLEVVKVDPSLVRIKGRHGMTPLLVAVSRKKIDLMSEFFLGCPESIVDANVNGENALHIAVNNYDQREGLSVLKVLMGWILRLCQKDAEWIETRVINRRDKDGNTPLHLAAYEINRQAMKLLLESSKINVNIENKNGLTVFDIAVLHNNREIERMVKRHGGKRSVSLVKIKTTSDILASQLSWRESRRTKKIRFYSWISEERRNALLVVATLIVTATYQTVLQPPGGVSDGGGQKSGTSGPKAGSVVMDEVYFIWLWLWNSAGFCFAIEMMIRLLSLGQESMFWYYPLFVPMVLAYSVAGDVIKPNARAYTIAGVGAIVVLIIWGLVVWFWEWVQSKRTKQRGPKSGLVWEGFTTLDQARGVAPNRYVIR

SEQ ID NO: 5386 - protein, 285 aa, Arabidopsis thaliana
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 5387 - protein, 209 aa, Eleusine indica
ISVLCDAEVALIIFSTKGKPYEYSTDSCTDKILERYERYSYAEKVLISAESETQGNWCHEYRKLKAKVETIQKCQKHLMGEELETLNFKELQQLEQQLECSLKHIRSRKSQLMHESISELQRKERSLQEENKVLQKELAEKQKAHKQQGQWDHGQQPQTSSSSSSFMMREAPPTVNISNYTASAGVRVDGAADQPQVRIGLPPWMLSPF

SEQ ID NO: 5388 - protein, 292 aa, Medicago truncatula
MQEPSLGMMQGSGGGYGGDGGGENRQLKAEIATHPLYEQLLSAHVACLRVATPIDQLPLIDAQLSQSHHLLRSYISQQTHSLSPHDRQQLDNFLAQYLIVLCTFKEQLQQHVRVHAVEAVMACRDIENTLQALTGVSLGEGSGATMSDDEDEQLQMDYGLDNQSSGGGGDHDMMGLGPLLPTESERSLMERVRQELKIELKQGFKSRIEDVREEILRKRRAGKLPGDTTSVLKNWWQQHAKWPYPTEDDKAKLVEETGLQLKQINNWFINQRKRNWHSNSQSVTSLKSKRKR

SEQ ID NO: 5389 - protein, 117 aa, Lupinus sp. Pennington 815
  misc_feature (37)..(37): Xaa can be any naturally occurring amino acid
RVRLSIEIARKFFDLQDMLGFDKASNTLEWLFNKSKXAIKDLARSKKNNGGEGDANSLSSSSDREECNEVVSGINNEQQGITIADHDSNGVKDMKKLKRAQKEPACVRAKMKESREK

SEQ ID NO: 5390 - protein, 189 aa, Arabidopsis thaliana
MAKEGLALEITELRLGIPGDNYSEISICGSSKKKKRVLSDMMTSSSLDTENENSVVSSVEDESLPVVKSQAVGWPPVCSYRRKKNNEEASKAIGYVKVSMDGVPYMRKIDLGSSNNYINLVTVLENLFGCLGIGVAKEGKKCEYIIIYEDKDRDWMLVGDVPWQMFKESCKRLRIVKRSDATGFGLQQD

SEQ ID NO: 5391 - protein, 175 aa, Zea mays
  misc_feature (157)..(157): Xaa can be any naturally occurring amino acid
VGREAGREGAMEQGEEDGDWMMEPAAGKKGGAMIDRKKRFSEEQIKSLESMFATQTKLEPRQKLQLARELGLQPRQVAIWFQNKRARWKSKQLERQYAALRDDYDALLSSYDQLKKDKQALLNQLEKLAEMLREPGGAKCGDNAGAARRDDVRLAVXGMNMKDEFVDAGGASKLY

SEQ ID NO: 5392 - protein, 231 aa, Eleusine indica
ISVLCDAEVAVIVFSPKGKLYEYATDSRMDKILERYERYSYAEKALISAESESEGNWCHEYRRLKAKIETIQKCHKHLMGGDLESLNLKELQQLEQQLESSLKHIRSRKSHLMVESISELQKKERSLQEENKALQKELVERQKMARQQQQPQVQWDQQTQTPAQAQTSSSSSSFLMRQDQQALPPPSNICYTPVTMGERGEEFAAAAAAPQVQAQLRIGGLPPWMLSQFNA

SEQ ID NO: 5393 - protein, 101 aa, Lupinus sp. Pennington 815
RVRLSSEIARKFFDLQDMLEFDKPSNTLEWLFTKSENAIKELARSKNSSSCSQKQPHNNNTSNEKVASLSGDASKGRVKLKCGQRDQDVSSVQTKKESREK

SEQ ID NO: 5394 - protein, 329 aa, Vitis vinifera
MEAPNNNIIAPFVMKTYQMVNDSSTDALITWGRANNSFIVFDPLDFSQRILPAYFKHNNFSSFVRQLNTYGFRKVDPDRWEFANEWFLRGQRQLLKNIVRKKHSSCGRSSFLLQAKLEDGDEEILAEIERLKHEQKSLEEELEGMTKRLEATERRPQQMMAFLYKVVEDPELIPTMMMEKERRRQLGEKKRRLLIQSTSSSSGTAGTASVKSEEEEDGSTVGIISSPETLSHSSPSPDTSTPAWVRPRQMMGWPLVAQQPYPLAAIPSPIYSGSVTGIGHFNTMSPPPENTISSYKSSDSGQLSYFTEMEDGVETRPLPYPFSLLEGGF

SEQ ID NO: 5395 - protein, 209 aa, Eragrostis pilosa
ISVLCDAEVGLIIFSTKGKLYEYATDSCTDRILERYERYSYAEKVLISAGSETQGNWCHEYRILKAKVETIQKCQKHLMGEELETLNLKELQQLEQQLESSLKHIRSRKSQLMLESISELQRKERSLQEENKVLQKELTGKEKAHRQQGQWDHTQQPQTSSSSSPFMMREAPPAVNASNYPAATGVRVEGPAEQTQIRVGLPPWMLSTL

SEQ ID NO: 5396 - protein, 119 aa, Physcomitrella patens subsp. patens
MSPRSTLKSRSKSQVMHPKQHYIHVRARRGQATDSHSLAERVRREKISERMKFLQDLVPSCSKVTGKAVMLDEIINYVQSLQRQIEFLSMKLAAVDPRLDINLLNLLNKEVHNLICEMA

SEQ ID NO: 5397 - protein, 375 aa, Oryza sativa Japonica Group
MWGLGLVKPMEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPPEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEAPGFWNSSMIGNGSSNGGGGGGSW

SEQ ID NO: 5398 - protein, 220 aa, Oryza sativa Japonica Group
LKKGPWTEQEDVQLVWFVRLLGGRRWDFLAKVSGLQRSGKSCRLRWVNYLHPGLKRGRMSPEEERMVVQLHAKLGNRWSRVAKSIPGRTDNEIKNYWRTHLRKLKLKQQKQQQSDDHHNDNDDDDDRNSSSSSSSSNSNSNLQQQPQPEDESSASGSLQAQHHEDQHQLFLHPLWNDIIVDVDCWSSSTNVVAPPPMPASPLWDIDDAFFCSDYSLPLWG

SEQ ID NO: 5399 - protein, 517 aa, Arabidopsis thaliana
  misc_feature (13)..(13): Xaa can be any naturally occurring amino acid
MELPQPRPFKTQXHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 5400 - protein, 273 aa, Gossypium hirsutum
MDSGGSSSSSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAAGEASESPTKSSTAVKHEPSTSQPDTEPDSGMEDGFACLTEDSILTTGDEFAWFGEMETTSSTVLESPLFSERDNSEADDTAMIFPMREEDESLFADLEELPECSFVFRHQRNVGPQVGIC

SEQ ID NO: 5401 - protein, 435 aa, Oryza sativa Indica Group
MPQLEEKDSSDLAINKGPSLDLVKSPLMMNDASATVTAMQPNEGMEEFPVKVRKPYTITKQREKWTEEEHDKFLEALKLYGRSWRQIQEHIGTKTAVQIRSHAQKFFSKVVREPGSNNAIEIPPPRPKRKPLHPYPRKCANSGSDANPATAQLKLAPGSSSSGSDQENGSPISVLSAMQSDAFGSSVSNPSTRCTSPASSDDGNNIPTFTSGEDNNVPCEPTVIDPSQSHKEIDQDRKDVNNMSEEDSSEEEVQETSLKLFGRTVVIPDPRKRSSSDPKHESEEQISQPSNEEMLQASSSVGEIPAAYCAPNGWFMSYNSFPFQFGESAADARIPPLHVWWPYYGFAPISHPRGLSTVMQQTEGSDESDGGKSHSSESSSDSGENVQMTAPQSSRIVESLGAIYVRDSGSSFELKPSANSAFVRVKPSNSGDEEI

SEQ ID NO: 5402 - protein, 202 aa, Zea mays
MSSEAEEFAEFSALFERMIRRGEGLSRFLPLILALAGEADEDGESTDQTATHREIVIDPVNRRVVMIRSALGEFLNGDFSEKQGRSPASKLSVESLPRVVIGKDEERRGSCPICLEEWSEGDVAAEMPCKHRFHSKCVEEWLGRHATCPLCRYEMPVEEVEEEKKVGVWIGFSVGNGERRNGEEDGGGRSEGGSNTRDETEA

SEQ ID NO: 5403 - protein, 358 aa, Oryza sativa Japonica Group
MSQRRVAGPMGVMSKQQQEAMAEEMMELRRGPWTLEEDNLLMNYIACHGEGRWNLLARCSGLKRTGKSCRLRWLNYLKPDIKRGNLTPEEQLLILELHSRWGNRWSRIAQHLPGRTDNEIKNYWRTRVQKQARQLKVDANSTVFRDAVRCYWMPRLLEKMAGAATDPTPPPPPPLHHHAAMATASSSPFDFDTHLQQAEAATACVVPNNVYHHHIDPSPSTSTSAGSTAAAAAFQPLPCFSELRWDQQMQSSGELDDGAAGVFVDSASALGSLSLDGLDLGPAEYYSDSTLLDYLNSSCTGSAMMTMMTASGNAGSYNYCGGAMDGGDTWRSDELMDELFHHIDQDRSTSDRSSKNQK

SEQ ID NO: 5404 - protein, 140 aa, Picea glauca
VEDGSGGETDFQEVDHHAVEDRELKDHLLRRYSGYLSSLKQEFLKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 5405 - protein, 144 aa, Brassica napus
MAPLPLIPNQTQSETRLFSSDPKKKKSRKKQTPLPQTQTQTQTLKKKTVQSSSSSWSQIKNLLSCKQIEGPRVHEPSKITSSSCGSSLCKFSDVIYGNARVIHRSDHSPGSSNLGQDAGLLTRKPVTRGSSATVRSNGCGAYTS

SEQ ID NO: 5406 - protein, 396 aa, Zea mays
  misc_feature (293)..(293): Xaa can be any naturally occurring amino acid
MEAKPGEASVGHAPAPMAAAAPVMAAPPLEETVSFQQPLPAPAAAAERGSSSAVLVPPLATAAGGGAMALVPVLMKVPKKRGRPRKYGPDGSLIRPLNATPISASAPLPAAVAPGHYTPASAVGAAMKRGRGRPLDFAAAAAKQHQQHHHQLYQHQQQQFGFHFDSIGDMGACSAGANFTPHIITVAPGEDVMTKVISFSQQGPRAICVLSANGVISTVTLCQPDSSGGTLTYEGRFELLSLSGSFMPTENGGTRSRSGGMSVSLASPDGRVVGGGVAGLLVAASPVQSPHLXIVVGSFLPSYQMEQKNKKPRVDAAPAAAVPQTPPAVPISSTDTRSSEQGQQSSASQRGVNMTVPGGTYGADQSWVLSPAPQQPMAEVSRTPSSGDLKMTTSGS

SEQ ID NO: 5407 - protein, 221 aa, Arabidopsis thaliana
MDDCRDKRRRRCTKLTCGTDNNDMEKMMHRETERQRRQEMASLYASLRSLLPLHFIKGKRSTSDQVNEAVNYIKYLQRKIKELSVRRDDLMVLSRGSLLGSSNGDFKEDVEMISGKNHVVVRQCLVGVEIMLSSRCCGGQPRFSSVLQVLSEYGLCLLNSISSIVDDRLVYTIQAEFIKMVGKNKNLCGCVVRGCMCIIKVNDMALMIDLAELEKRLIRMK

SEQ ID NO: 5408 - protein, 254 aa, Sinapis alba
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKEREKVLRAQQEQWDEQNHGHNMPPPPPLQQQIQHPYMLSHQPSPFLNMGGLYQEDQIAMRRNDLDLSLEPVYNCNLGCFAA

SEQ ID NO: 5409 - protein, 423 aa, Oryza sativa Japonica Group
MPFAAEFDMLAFNNPIELLSNAYVLCMGPTHRSIKLGTTRKQYKQLGFPIKKAGKVCLWHVFLEPGQLALAAASDSDRSKDKHEDQKTLRRLAQNREAARKSRLRKKIHGKWKSFAKILWGITCKNRLGMGIGCWSGHGRELQGYIGMQDLQSRTVPSNSGQLQAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 5410 - protein, 312 aa, Medicago truncatula
MLGFGGNSCSEISSMDHQNQMMNMETNRKFFSFPLSNNSSGVQNHHNYTQHQNNTNNNTCRDKIMAHPLFPRLLSSYLNCLKVGAPPEVVASLEESCAKCEILNGSSGRTGSSSSCIGEDPGLDQFMEAYCEMLIKYEQELTKPFKEAMLFLSRIESQLKAVAVSTDFGQSEFAASQNEIDVHENNLDTTQGEDQELKVQLLRKYSGYLGSLKKEFLKKKKNGKLPKEARQQLLDWWSRHYKWPYPSESQKQALAESTGLDLKQINNWFINQRKRHWKPSEDMQFAVMDATNYYMENVMCKPFPMDAMPMLL

SEQ ID NO: 5411 - protein, 389 aa, Arabidopsis thaliana
MDRRLLWVTDSGNVDALYALIHKDPYILQNIDVLPFVHTPLHEASSTGKTDLAMELMVLKPTFAKKLNSDGVSPLHLAVENHQVQLALELVKINPDLVLVAGRKEFLLACPESIKDTNVNGETALHIAVMNDRYEELKVLTGWIHRLHKSDAASTEIHVLNKRDRDGNTILHLAAYKNNHKVVKELLKCISLNRDIQNKGGMTALDILRTNGSHMNIKTEKIIRHSGEYCSTTMTRYKNRMSDGTRNALLVITALIITATYQTAVQPQDKDEIYYTGNIMINVLFVWGFNTIAFCLAIALTFILLPVGKAYNWWYIFISVPLVCSYALSMFLKYIQFPILCMPLYLMMAFILGFLIYVFVLYVGWKRAKQEKVPEPKSELTFEGFTSMT

SEQ ID NO: 5412 - protein, 220 aa, Zea mays
  misc_feature (210)..(210): Xaa can be any naturally occurring amino acid
MVRMKQVKISVKKDVDSYTIRGTNKVVHVGDCVLMRASDSDKQPYVARVEKMEADGRGSVRVQVRWYYRPEESKGGRRQFHGAKELFLSDHFDLQSAHTIEGKCVVHSFKNYTKLDNVGPEDYFSRFEYKAATGSFTPDRVAVYCKCEMPYNPDDLMVQCEACKDWFHPSCMAMTIEQAKKLDHFVCSDCLKENGSKRLSNVYATSSNSXPKAESIRQTR

SEQ ID NO: 5413 - protein, 548 aa, Gossypium hirsutum
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVTAYPPVKSDPGLENTRKRAKTESSSSSSSTTTRPVVLIDSQETGVRLVHTLMACAEAVQQDNLKLADALVKHIGLLASSQTGAMRKVATYFAEALARRIYRIFPPDSLDPSYNDKLQMHFYETCPYLKFAHFTANQAILETFSMANRVHVIDFGLKQGMQWPALMQALALRPGGPPAFRLTGIGPPQPDDTDALQQVGWKLAELAERIGIEFEFPGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFASGDGYRVEENNGCLMLGWHTRPLIATSAWRLAGTESGSELTQELS

SEQ ID NO: 5414 - protein, 211 aa, Pyrococcus abyssi GE5
MIGVEEELKPEKIQEIRLGDCPVCGGKGTLKAIQFIHRIPYFGEVMESTVICEKCGYRSADVMILEEREPRVYEVRVENEKDLFTRVVRSKSGTIELEELGIKIEPGPAAEGFVSNIEGVLERAKEVLLMARDFKEQENDEEAVKKIDELLKYIEEVKEGKKPLTVRIMDPFGNSALIGEKVKSRKLTKEEIKKLSTGPYIVIEPEESPQQ

SEQ ID NO: 5415 - protein, 210 aa, Chasmanthium latifolium
ISVLCDAEIALIIFSTIGKLYEYSTDSCMDKILERYERYSYAEKVLISAESETQGNWCHEYRKLKAKIETIQKCQKHLMGEDLGTLNFKELQQLEQQLESSLKHVRSRKSQLILESISELQRKERSLQEENKVLQELAEKQKVHRQQVQWDQAQQPQTSSSSSSFMMREAPPSTNISTYPAATGGRVEAAAEQPQVRIGLPPWMLSHLSS

SEQ ID NO: 5416 - protein, 297 aa, Aeluropus littoralis
MMREAYMEVLPPMDHYAPRSRSNWSLTAPRIWTAEENKQFEQALAALDLRCPDWKKVAQAIPGRTVNEIVNHYKSLEVDVRQIELGVVPLSVCGGGGGANSFTLQWDGNGGRSAGDFRHGYRFAGGCGKRHPGRTPEQERKKGVPWTEEEHRLFLLGLKKHGKGDWRNISRYFVHTRTPTQVASHAQKYYIRLNSVGKDKRRSSIHDITTVNLNDEQPPSPSQSSLITNQSNASALTTAVGQFSLTADTKQHGATNLPFSSPSRTPVMPAYGMDMQDQGLPCGPTHDQLVANPSVLF

SEQ ID NO: 5417 - protein, 436 aa, Arabidopsis thaliana
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 5418 - protein, 104 aa, Lupinus angustifolius
RVRLSIEIARKFFDLQDMLGFDKASNTLEWLFNKSKRAIKELARSKKNNGSEGDANSFSSSSDREDCNEVVSGINNEQQGITIADNDSNALKDMKKLKRAQKES

SEQ ID NO: 5419 - protein, 140 aa, Aspergillus oryzae
MLEDPSYAEIVRWGDEGDSFVVLECEKFTKTILPKHFKHSNFASFVRQLNKYDFHKVRQNNEENGQSPYGQNGCLTRNLGMGIQAPRIPGEQQRITRQYSTEGACPSKTDPEQRRFRSNATDRSPEPANSGAATTNSASL

SEQ ID NO: 5420 - protein, 81 aa, Lupinus angustifolius
RVRLSIEIARKFFDLQDMLGFDKASNTLEWLFNKSKKAMKELARSKNSSSGVVANSFSSSDSECEVVSMINQDSIDATPEG

SEQ ID NO: 5421 - protein, 212 aa, Setaria italica
ISVLCDAEVALIIFSTNGKLYEFATDSCMDKILERYERYSYAEKVLISAESETQGNWCHEYRKLKAKVETIQKCQKHLMGEDLETLNLKELQQLEQQLESPLKHIRSRKSQLMMESISELQRKEKSLQEENKVLQKELVEKQKGQRQQPQWDQTPQQTSSSSSSFMMREAPPATNISYPVPVAAGGGRVEGAAPQPQPQARIWLPPWMLSPS

SEQ ID NO: 5422 - protein, 121 aa, Machaerium scleroxylon
RVRLSIEIARRFFDLQDMLGFDKASNTLDRLFTKSKKAIKELARTKHSGASEGNNNKSFSTSSECEDCEVVSGTRPQGLLDSNDKSLVAGDAAKEKKLKRAQKESASTSTARAKMKESREK

SEQ ID NO: 5423 - protein, 233 aa, Setaria italica
ISVLCDAEVAVIVFSPKGKLYEYATDSRMDKILERYERYSYAEKALISAESESEGNWCHEYRKLKAKIETIQKCHKHLMGEGLESLNLKELQQLEQQLESSLKHIRSRKSHLMVESISELQKKERSLLEENKALQKELAERQKAAASRQQQQVQWDQQTQQAQAQASSSSSSFLMRQDPQALPPPQNIWFPPVTIGERGDQAAAAAQQQQQQPGQAQPQLRIGGLPPWMLSPL

SEQ ID NO: 5424 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSLSSLPAVVEPCFSAGDDWMDDVRALASFLDTDDAWNLCA

SEQ ID NO: 5425 - protein, 364 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTVPNCLLIDKTNTSSFTGSNFTVDKALEASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 5426 - protein, 108 aa, Machaerium scleroxylon
RVRLSIEIARKFFDLQEMLGFDKASNTLEWLLTKSKRAIKELARSKNSSSAANSFSSSSEDEVDSVINQVIDGNLDLQQQGVVDSEERRLSRAQKEESRAKMKESREK

SEQ ID NO: 5427 - protein, 430 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 5428 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALATFLDTDDAWNLCA

SEQ ID NO: 5429 - protein, 329 aa, Oryza sativa Japonica Group
MPNRATHWCYACRRPIRVSGQDITCPNCNDGFIQEISEIGGSLNTYGIFDPSFDERRDRSFGMVEAMSDLMRQRMAEMGRNRVLDFHGTRGASSHQGRQPTVRPMLIFGSNAPDRVSSSSEEADILLRQGRRIGADRPNFSRFLVGPSLEALFEQLLLHNNRQGPPPAPQSAIDSMPVVKINLRHLRDDPHCPVCTDKFEVGTEAREMPCKHLYHAECIIPWLVQHNSCPVCRHPLPSSSHRSGSTRSSSTHSNEAISHGVARSDADPVPVARSDDSRNHEMHGSFSFLWPFDSPTPDSSSYTHEGGVGEPTVHDDAGQMTYSEWHYDY

SEQ ID NO: 5430 - protein, 139 aa, Chlamydomonas reinhardtii
MGRQVYLGGYEEEAHAAEAYDVAALKCKGAKAGVRTNFELGRYSGLLASLPHISLEELIMAVRRQSQGFSRGSSSYRGVTAHPSGRWESRIGIPGSKHIYLGLFEGERDAAAAYDRSLVRLKGPTAATNFSLSEYRSEL

SEQ ID NO: 5431 - protein, 253 aa, Gossypium hirsutum
MTSPVGERFSEFFDKWICQLDGYLQQLVRVSREGLSESEHQTLVSKLTAHYKEYYTVKWAAAHEDVLVFYCPVWLSKLENACSWLTGWKPSMIFGVVESMRRKSVAELTEEQVRKIEQLRVKIKLEEEKVEREMERQQVAMADRKMVELVRTARRIRNEELVVVVGNHQVEGLVEVALKGVLAGLERVMKAADCVRLKALKGVLDVLNPSQSLDFLAGICMLQIQIRKWGQNRDNQKGSNPIILGELHNNVIF

SEQ ID NO: 5432 - protein, 349 aa, Gossypium hirsutum
MIEMHDEEQGEDVRAMPSRSRKCSSFDLNDEAGSERDCIGETSVEEEEIENITEGSSSNNNNGNGNDRRRVRQYVRSKLPRLRWTPDLHYSFVRAVERLGGQERATPKLVLQLMNVRGLSIAHVKSHLQMYRSKKLDEAGQVLSQSKRAIQGRGEFGSLLCQAMTTLSPHHRHQQQHFRMENGGIVLASESLDGSNTTFKANFPRHHQFPNSFISKAFGQENGFYIQNQIHGTGPIRAMASRFLEEKRWHPFERISNRWKVNGNMYKDMQSQSHCFWQRPSSDEDKHEPLTKFSSCRTEFEWNQDKVLKDGERLPDLQLRLSQRNGKFDEEKNNHCKGTHEISTQLSLS

SEQ ID NO: 5433 - protein, 223 aa, Aspergillus oryzae
MSGLADPASRNTVVSGATDVPGRTRKLPLLSSSVPASGQPMGDPMEVTPPASAAATGAGPSAHNNSDNDRAGASTIATSNGSTEPAHVHNHVAPSQAIGAAAAAQQPKVVQTAFIHKLYNMLEDPSIQHLISWSQTNDSFVMSPTPEFSKVLAQYFKHTNISSFVRQLNMYGFHKGMSTRLVNEFRPLSVAHMERLSERCVPHWIARLGTLGVQAREWQFQTW

SEQ ID NO: 5434 - protein, 234 aa, Oryza sativa Indica Group
MAKSRPPKRILESYTIKGSDKVIKHYGSSVSGDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKLSLSSAFVFGEFLYHQSIM

SEQ ID NO: 5435 - protein, 340 aa, Oryza sativa Japonica Group
MGRGRAPCCAKVGLNRGSWTPQEDMRLIAYIQKHGHANWRALPKQAGLLRCGKSCRLRWINYLRPDLKRGNFTADEEDTIIKLHGLLGNKWSKIASCLPGRTDNEIKNVWNTHLKKRVSQREKPGDTKKKGKAADASDDADAHSPSSSASSSTTTAANNNNSGDTAGEQCGTSKEPENVDVSFFEQDIDISDMLVDAPTEAPLVAAPMPPSPCSSSSLTTTTCVGAVSDELLDLPEIDIEPDIWSIIDGYGGDEPGDGDATVPCTASPGEEGAEWWVENLEKELGLWGPMDESLAHPDPPGQVCYPGPLTETEGDPVSTYFQSGPTASPLQEIASPAVLS

SEQ ID NO: 5436 - protein, 140 aa, Picea glauca
VEDGSGGETDFQEVDHHAVEDRELKDHLLRRYSGYLSSLKQEFMKKKKKGKLPKDARQKLLDWWSLHDKWPYPSETEKIAFAECTGLDQKQINNWFINQRKRHWKPSEDMHFMVMNSHSPHSAALYVERHLMTEGYHLDC

SEQ ID NO: 5437 - protein, 390 aa, Triticum aestivum
QLLLNNPHTFVVITLDPPIRKGQTLYPHIVIQFVTENVVEKELSLSEEVLAEKYKDRLQSSYNGLEHEVFSKILRGLSGAKVTRPSTFRSCQDGYAVKSSLKAEDGLLYPLEKGFFFLPKPPTLILHEEIEYVEFERHGAGGASMSSHYFDLLVKLKNDQEHLFRNIQRNEYHNLFNFVSGKNLKILNLGEDGQDRTGAVAAALQSTDDDPVDPHLERIKNQAGDEESDEEDEDFVADKDDSGSPSDDSEEGSDASISDGEKEKSSKKEASSSKPPAKRKPKNVDVEGSEKRKPKKKQKKDPNAPKRAIAPFMYFSKAERANLKNINPELSTTDIAKKLGEKWQKMSAEEKQPYVEQSQVDKKRYAEESAAYRGAGAAPVDVDSADGSSD

SEQ ID NO: 5438 - protein, 362 aa, Zea mays
MSQRKGAMAAAVTASKHREDQEAMMVELRRGPWTLEEDNLLMNYIACHGEGRWNLLARCSGLKRTGKSCRLRWLNYLKPDIKRGNLTPEEQLLILELHSKWGNRWSRIAQHLPGRTDNEIKNYWRTRVQKQARQLRVDANSAVFRDAVRCYWMPRLLEKMAAHHHGDGELPPPLHPSHNIAGTASSRSPPAHGSQQEDPSSSAPAASGHYLQQVDPSPSTSTTSGSTTSAALPPVPCFSESELRWVVDQYGAAYGYTDDLDLDGGAGVVDDDSAAAAALDSLGLDGLDLGPADGGVYSDATLLDYLNATCAGGTTVMTMMGGVHGAAGGGDGHYGPAPWRTDELGQAARKLGDPQHQWRGGI

SEQ ID NO: 5439 - protein, 272 aa, Oryza sativa Japonica Group
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRARA

SEQ ID NO: 5440 - protein, 302 aa, Capsella rubella
MADDWDLHAVVRGCSAVSSSATTSTTTVFSGGVSSHTNPTFTVGRQSNAVSFGEIRDLYTPFTQESVVSSFSCLNYPEEPRKTKNQKRPLSLSASSGSVTSKPTGSTTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQPMTTKSPTTTIATYSSSPVTSADEFVLPVEDLAVGEGLDGDEDLLSLSDTVVSDDFFDGLEEFAAGDSFSGNSAPACFDLSWVVNSAATTTGGI

SEQ ID NO: 5441 - protein, 343 aa, Glycine max
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYVGKAPKGTKTNWIMHEYRLLDSSRKNTGTKLDDWVLCRIYKKNSSAQKTAQNGVVPSNEHTQYSNGSSSSSSSQLEDVLESLPSIDERCFAMPRVNTLQQQQHHEEKVNVQNLGAGGLMDWTNPSVLNSVADFASGNNQVVQDQTQGMVNYNCNDLYVPTLCHLDSSVPLKMEEEVQSGVRNQRVGNNNSWFLQNDFTQGFQNSVDTCGFKYPVQPVGFGFRN

SEQ ID NO: 5442 - protein, 244 aa, Musa acuminata
MGRGRVELKRIENKINRQVTFAKRRNGLLKKAYELSVLCDAEVALIVFSNRGKLYEFCSSSSMLRTLERYQKCNYGAPETNIISRETQSSQQEYLKLKARVDGLQRSQRNLLGEDLGPLNIKELEQLERQLDASLRQIRSTRTQYMLDQLGDLQRLGTNAMWSLIKPWKIRLEESSEADQQQLWDPNTHAVAYGRQQPQPQGDGFFQFIDCEPTLQIGYHPDQMAIAAAAAAAPGPSYMPGWLA

SEQ ID NO: 5443 - protein, 291 aa, Glycine max
ESSTQFRVGKASDLLVLERKHSQHSTEILANPWWTGHQVGLGVGVDPAATNSPSSNLNKRHMDLSINERSLVRERQEEEEEEEDERDNGDEPKEGAVEAGTRRPRGRPPGSKNKPKPPIFVTRDSPNSLRSHVMEVAGGADVAESVAQFARRRQRGVCVLSGSGSVANVTLRQPSAPGAVVALHGRFEILSLTGAFLPGPAPPGATGLTVYLAGGQGQVVGGSVVGSLVAAGPVMVIAATFANATYERLPLEEEEDDGGGSVQGGSTLGGSPHGIGSSGGGGGSGGGHLPV

SEQ ID NO: 5444 - protein, 169 aa, Triticum aestivum
MSPAEMESDKVVEASGGAGDPKACDDCNTTKTPLWRGGPNGPKSLCNACGIRYRKRRRVAMGLDPEAKRKPKRDDAALSKAAAEAAAQASTPKTEEEDTKAGEEKAGDDEKAAKKTKRTATTHTVELHMVGFAKDAVLKQQQRRRRQMRREKPSCLGEEERAAILLMSL

SEQ ID NO: 5445 - protein, 320 aa, Oryza sativa Indica Group
MGEQQQQVERQPDLPPGFRFHPTDEEIITFYLAPKVVDSRGFCVAAIGEVDLNKCEPWDLPGKAKMNGEKEWYFYCQKDRKYPTGMRTNRATEAGYWKATGKDKEIFRNHHMLIGMKKTLVFYKGRAPKGDKTNWVMHEYRLADASPPPPPSSAEPPRQDDWAVCRIFHKSSGIKKPVPVAPHQVPAAANYQQQQQMAMASAGIIQVPMQMQMPSMSDQLQMLDDFSTTASLSLMAPPSYSTLPAGFPLQINSGAHPQQFVGNPSMYYHQQQQMDMAGGGFVVSEPSSLVVSPQDAADQNNNAADISSMACTMDAAIWKY

SEQ ID NO: 5446 - protein, 645 aa, Triticum aestivum
VVYLPQGHLDHLGDAPAPSPAAVPPHVFCRVVDVTLHADASTDEVYAQLSLLPENEEVVRRMREATEDGSGGEDGETVKQRFARMPHMFCKTLTASDTSTHGGFSVPRRAAEDCFPPLDYSQQRPCQELVAKDLHGTEWKFRHIYRGQPRRHLLTTGWSAFVNKKKLVSGDAVLFLRGDDGELRLGVRRAVQLKNGSAFPALYSQCSNLGTLANVAHAVATKSMFQIFYNPRLSQSEFIVPYWKFTKSFSQPFSVGSRFKMRYESEDAAERRYTGIITGTGDADPMWRGSKWKCLLVRWDDDGEFRRPNRVSPWEIELTSSASGSHLAAPTSKRMKPYLPHANPEFTVPHGGGRPDFAESAQVRKVLQGQELLGYRTHDGTAVATSQPCEARNLQYIDERGCSNNGSNNVLGGVPSHGVKTPLGIPYHCSGFGESQRFQKVLQGQEVFRPYRGSLVDARMRSGGFHQQDGPYASALLDKWRTQQQHAFGFGSSAPVLPSQPSLSPPSVLMFQQADPKVSRFEFGQGHLDKNMDDPYARFVSAEAIGRGEQTLSLRPHLGSEVIDTRVAVENKGVAPTNSCKIFGISLAEKVRARDEMGCDDGGANYPSSTQPLKQQVPKSLGNSCATVHEQRPVVGRAIDVQQWI

SEQ ID NO: 5447 - protein, 219 aa, Festuca arundinacea
MDIFRSYYSDPLAECSSISDSSSSSCNRANLSDEEVILASNNPKKRAGRKKFRETRHPVYRGVRKRNSDKWVCEVREPNKKSRIWLGTFPSAEMAARAHDVAAIALKGRSACLNFADSAWKLPIPASTDAKDIQKAAAEAAEAFRSSEAENMPEYSGEDTKEVNSTPENMFYMDEEALFCMPGLLANMAEGLMLPPPQCSQIGDHMEDDFDMPLWSYSI

SEQ ID NO: 5448 - protein, 233 aa, Daucus carota
MGRAPCCEKMGLKKGPWSSEEDQILISFIQQNGHGNWRALPKLAGLLRCGKSCRLRWINYLRPDIKRGNFSKEEEETIIELHQKLGNKWAAIAAKLPGRTDNEIKNVWHTHLKKKLKNYDQVKNESNVKMQVESENRRNSPQHSTSELSSVTDSSAKAKCVIKSEQNTELSESSKIPEIDASFWSEEFTINNQDKGVPGIIEEFQESGNVDAEMDFWCNLFSGAEDFKDLPEF

SEQ ID NO: 5449 - protein, 209 aa, Pennisetum glaucum
ISVLCDAEVALIIFSTKGKLYEFATDSCMDKILERYERYPYAEKVLVSGESETQGNWCHEYRKLKAKVETIQKCQKHLMGEDLETLNLKELQQLEQQLESSLKHIRTRKSQLMMESISELQKKEKSLQEENKVLQKELVEKQKAQQQQPQWDQNPQQTSSSSSSFMMREAPPATNISYPAPVAAGGRVEGAQPQPKARIGLPPWMLSPL

SEQ ID NO: 5450 - protein, 118 aa, Amicia glandulosa
RVRLSIEIARKFFDLQDMSGFDKASNTLEWLLNKSKKAIKDLARTTNNHNHNHNHNSSFSNYNSSSSDEGEVDSVINHQQDHEEEEEEEEAGPNGNSEELKGKKMMMRREKMKESREK

SEQ ID NO: 5451 - protein, 473 aa, Arabidopsis thaliana
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTSYQGTSSPNISVGSSSRHLSSCSSTDSCKDLQTCTDPSIISREIRELTQEVKQEIPRAVDAPMNNESSLVKTEKKGLFIVEDAMERNRKKPRFIYLMKMIIGNIISVLLPVKRLIPVKKL

SEQ ID NO: 5452 - protein, 135 aa, Amicia glandulosa
RVRLSSEVARKFFDLQDMLQFDKPSNTLEWLFTKSDNAIKELARTKHTCCTCTSNNNNNDNNNISDKCFYCCNNNSEQQDAGAVQLQHSTSEKWMSSLIDSSSCSSTKGRNNNNKLKWTQREDVCVQSKKESRDK

SEQ ID NO: 5453 - protein, 210 aa, Pennisetum glaucum
ISVLCDAEVALIIFSTKGKLYEFATDSCMDKILERYERYSYAEKVLVSGESETQGNWCHEYRKLKAKVETIQKCQKHLMGEDLETLNLKELQQLEQQLESSLKHIRTRKSQLMMESISELQKKEKSLQEENKVLQKELVEKQKAQQQQPQWDQNPQQTSSSSSSFMMREAPPATNISSYPAPVAAGGRVEGAQPQPKARIGLPPWMLSPL

SEQ ID NO: 5454 - protein, 256 aa, Oryza sativa
YTVILRILPYNIEFKRRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHSGYHHHHHQKPLVKAEPNDQSAAATTAATVPVKEEAAMEHSDLMQQMFSQSYRPMIPEAAAGGHHDDFFADLAELESDPMSLIFSKDGGHAGNERRRATRETFVDFSRRPMLAKV

SEQ ID NO: 5455 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRPPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 5456 - protein, 264 aa, Festuca arundinacea
MSRKKKVRRRSTGPDSVSEIIKKWKEQNQKLQEENGARKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSHLADGKDESESPPSLTSDAPTATLDRSDAKDEPESAGTVVHEVKTEVSNDSTSVREERKAVEVFQPEGKALRKEEKVSYDYFNVEEVLDMIIVELSADRKMEVHEEYQDGDDGFSLFSY

SEQ ID NO: 5457 - protein, 596 aa, Oryza sativa
MGAMPAVKVEEEEEERNPVASSPSVSEGSAHAAALASPTAADSIFGRRRKSGPVRRAKGGWTPEEDEKLRKAVDIYNGKNWKKIAESFSDRTEVQCLHRWQKVLDPELIKGPWTQEEDDVIINMVKKHGPKKWSVIARSLNGRIGKQCRERWHNHLDPQIRKEAWTVEEERVLARAHCMYGNKWAEIAKLLPGRTDNSIKNHWNSSLRKKIDDYNTRDILPVHPPVVGDGLKQLPKRPPADNHFDLNKEPIICSRDRLGVVHSDPTSHQRASNLKDFKGCADYLSLGQPVTSCEASAADDSAFDLATQGMRMDSVHDKGTGNNFVCGKVQGINFLGDKGLKINQISDKMGCSRQAKREGEAAINGGGSSLQSEAHSVGSLCYQISKMEDIAPAQSPVFTANYVPEHSRNVMHSPNGYTTPPTHGKGSDQLSVESILRSAAEKFHGTPSILRRRKRDKPTPAEDNDLKIGRLSSDDFHTPIGKCTTDSPQSFKTAALLSLGPMDEQGSLDVSPPYRLRSKRLAVLKTVQNHLDFSSDEMSICDTTMKSACGNSDCANASSGVSSIQGKKLDEHMIGLETLTMNFAHTTKLDATQPNL

SEQ ID NO: 5458 - protein, 120 aa, Dussia macroprophyllata
RVRLSIEIARKFFDLQDMLGFGKASNTLEWLFTKSNKAIEELARSKHSSSGVANSSTSSSECEVVSGINQVVTDTPDLQGVDSNDKSMVGAADAAKERKLKRAQKEPACVRAKMKESREK

SEQ ID NO: 5459 - protein, 127 aa, Schizanthus pinnatus
CTAQGVRDRRMRLSLQIARKFFDLQDTLGFDKASKTIEWLFSKSKKAIKELTENAPQEHNYSNRENNNIVVNNNNSSSSEEGNKSESLMSECEVLSSKEENSNSPFEKDHRKLRKMVHNLHTRESRD

SEQ ID NO: 5460 - protein, 228 aa, Brassica napus
RPTRPVKPLEEIVTNTCPTPQASQPQPPPSVGAAGVAERKTRPEKDQAINCPRCNSVNTKFCYYNNYSLTQPRFFCKGCRRYWTEGGSLRNIPVGGGSRKNKRSHSSSISSSDIGNNHSVSTQPATKKHRSDQHHHHLMSMSQQGLTGQNPKFLETTQQDLNLGFPPHGLIRTNFTDLIHNIGNNNKSTNSLLLSSSCSATSDMATSPLDFIRNNNSNNGNTSNSSFM

SEQ ID NO: 5461 - protein, 144 aa, Brassica napus
MEDRSCQVLFPSSSVDHRLSGDQTQINTSSSLQQHNTNKEEKHKSKKKEREARFAFQTRSQVDILDDGYRWRKYGQKAVKNNPFPRSYYKCTEKGCRVKKQVQRLSGDEGVVVTTYQGVHTHPVDTPSDNFHHILTQMHIFPPF

SEQ ID NO: 5462 - protein, 122 aa, Dussia macroprophyllata
RVRLSIEIARKFFDLQDMLGFDKASNTLEWLFTKSKKAIKELARSKNSSSGGGKSFSSSSECEVVSGINNQVATDTPNLQGLDSNDKSLMAAADDAAKERKLKRAQKEPASIRAKMKESREK

SEQ ID NO: 5463 - protein, 234 aa, Triticum aestivum
MTDGHLFNNILLGGRTGTNLGQFKVHSGGLAWKRQGGGKTIEIDKADLTSLTWMKVPRAYQLGVRIKDGLSYTFIGFREQDVSSLINFMQKNLGISPDEKQLSVGGHNWGGIGIVGSMLTFMVESKQAFEVSLADVSQTQIQGKTDVLLEFHVDDTTGANEKDSLMDMSFHVPTSNTQFPGNENRTSAQILWEAILARADNGSGSSGEAVVTFEGIAILTPRGRYAVELHLPFL

SEQ ID NO: 5464 - protein, 109 aa, Schizanthus pinnatus
CTAQGIRDRRMRLSLQIARKFFDLQDMLGFDKASKTIEWLFTKSKNAIKELSGNITHSNSNNNNNNNINNNSESLVSECEEINSNNEAKDTGKDIIMLDSRDDKKESRD

SEQ ID NO: 5465 - protein, 135 aa, Picea mariana
GGSSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGTDC

SEQ ID NO: 5466 - protein, 102 aa, Dussia macroprophyllata
RVRLSSEIARKFFDLQDMLEYDKPSNTLEWLFNKSENAIKELARSKHNCSGAAKCFCFSSEQQREDSNEKSLMGAGASKERMLKCAEKENVCVQAKKESREK

SEQ ID NO: 5467 - protein, 109 aa, Schizanthus pinnatus
CTAQGIRDRRMRLSLQIARKFFDLQDMLGFDKASKTIEWLFTKSKNAIKELSGNITQSNSNDNNNNNINNNSESLVSECEEINSNNEAKDTGKDIIMLDSRDDKKESRD

SEQ ID NO: 5468 - protein, 112 aa, Schizanthus pinnatus
LTAQGPRDRRVRLSIAIARKFFDLQDTLGFDKPSKTLDWLFSNSKIAIDELTQTNPSKISKNTSTTPSPTSEREDNMVIAPTHEASSQRKPLLKRGKPKKHTVNVLAKETRA

SEQ ID NO: 5469 - protein, 256 aa, Selaginella remotifolia
ETWLVTTTSSSNPEVGLATGLAATGGAQDLLNPPLNKQKEPPVGRGKIEIKRIENATSRQVTFSKRRGGLLKKAHELSVLCDAQVALIIFSSTGKLFEYASTSMKEILDRYGKYPESVQGGNMASHHEASDFISHEIRRLKQQLQRSQQSRRHLLGDDLSHLPIKDLQNLEQQLEVGLSRVRSRKDQVLMDQVDELRRRELTLHKDNEMLRRRLSDVQGMAESGRSTLIVNPWRQGNLLQTWQMYPCHFLDTKAAA

SEQ ID NO: 5470 - protein, 118 aa, Echium plantagineum
CTAQGVRDRRMRLSLPIARKFFDLQDILGFDKASKTIEWLFSKSRKAITKLLINNNLPPSNHRYLSDVEYVNPDDDEDEEEGDDEDDDVKMEEIIEKEELSKSRKVMINYQNAKESRE

SEQ ID NO: 5471 - protein, 280 aa, Brassica napus
IEWKDGHSPSWVPSSYIAAEGVSEYETAWWTAARKADDQALAQLLEPSEGRRDANTVDENGRTALLFVAGLGSDKCVRLLSEAGADLDHRDIRGGLTALHMAAGYVQPDAVAALVELGADAEVEDERGLTPLELAREILKTTPKGNPMQFGRRIGLEKVISILEDQVFEYAEVEEILEKRGRGKDVEYLVKWKDGGDCDWVKRVHVAEDVVKDYEAGLEYAVAEKVMGKRMGDDGNTEYLVKWTDMADATWEPEENVDISLVQLYEQERRGSTLLMSRLG

SEQ ID NO: 5472 - protein, 263 aa, Oryza sativa Japonica Group
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKVRNIIIYASFF

SEQ ID NO: 5473 - protein, 236 aa, Oryza sativa Indica Group
MASKEPSGDHDHDHELNGTSGGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEDQEEAAAGGMMAPPPLMAGAADPLLFSGGMHDAGLAAWHHARPPPPY

SEQ ID NO: 5474 - protein, 459 aa, Oryza sativa Japonica Group
MWDLNDSPAAEAAPPPLSPSADDSGASSSSAAAVVEIPDDADDDSAAVVVVTRQFFPPAVPGGGGDPAPGNARAGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTEEEAARAYDRAAIKCNGKDAVTNFDPSIYAGEFEPPAATGDAAEHNLDLSLGSSAGSKRGNVDGGGDDEITGGGGGGAGSDQRVPMAFDLDWQTAAARSTKAKFDQNSNHPQMPPVLQVTHLPFSPRHHHQFLSNGDPGTAGGLSLTIGAGMAGHWPPQQQQGWGNAGGMSWPHPPHPPPPPTNAAAAATATAAAASSRFPPYIATQASTWLQKNGFHSLTRPT

SEQ ID NO: 5475 - protein, 471 aa, Oryza sativa
MESFSFHVFPHTAKSPRPNKGEDGGGEAEASHRRGKGDAMWDLNDSPAAEAAPPPLSPSADDSGASSSSAAAVVEIPDDADDDSAAVVVVTRQFFPPAVPGGGGDPAPGNARAGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTEEEAARAYDRAAIKCNGKDAVTNFDPSIYAGEFEPPAAATGDAAEHNLDLSLGSSAGSKRDNVDGGGDDEITGGGGGGTGSDQRVPMAFDLDWQTAAARSTKAKFLSNGDPGTAGGLSLTIGAGMAGHWPPQQQQGWGNAGGMSWPLPPHPPPPPTNAAAAATATAAAASSRFPPYIATQASTWLQKNGFHSLTRPT

SEQ ID NO: 5476 - protein, 123 aa, Chelidonium majus
PRDRRMRLSLKVARPFFTLQDMLGFDKASKTVEWLLMNSKTEINELKRNRLLLSEMTMNKRSCSGSYTSECEVVSEIEISNTTTDDHQQGNAKKEKGVRRSRKPPTFHPLAKESRAKARERAR

SEQ ID NO: 5477 - protein, 548 aa, Arabidopsis thaliana
MSLSSNPPVCSPEKEERSEMKIEIQCMENKQPLAASCSSASEGSGCFFLKSPEIATPATVSSFPRRTSGPMRRAKGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRKDAWTVEEESALMNSHRMYGNKWAEIAKVLPGRTDNAIKNHWNSSLKKKLEFYLATGNLPPPASKFIVLKDIADGDRDSKQSSATKPFKDSDSLTQTSSGNTDSNEVGRDHFDSSSALLEEVAASRRIGVNEYACSPVEYKPQLPNLEPISEEVRINSKAYFERSIQRKVENGFGTPKHGNLYYKSPLDYYFPSEADLQHMYGYECGCSPGAASPVSLMTTPCNKDSGLTATRSPESFLREAARTFPNTPSIFRKRRKVVLAAKTDAVVVVNGVVKEVDRKEESKDMRKSLLLETTDNCSDDEELGLNGNAFNLSPPYRLRAKRTAVIKSRQLEFTSEKEKQPDNEIEFTSAKEKQPDNEIKTSEEDKPV

SEQ ID NO: 5478 - protein, 136 aa, Brassica napus
DAWANCVRAKTARTCDNCLKKQAHWFCAADEAFLCQSCDTSVHSANLLARRHERVRLKDSTSPQQEAPTWYHGFTRKPRTPRGSGKRNNSSTFQDMVPEISAEGQTDSSEVEGPLICQVPVLGPTVVEPKIKFPTM

SEQ ID NO: 5479 - protein, 256 aa, Jatropha curcas
MSYSNPDPPDPDPNPLPESKWIQFPEFPHPKPTWLNFLGPKPVPMKQVGSPPKPTKLYRGVRQRHWGKWVAEIRLPKNRTRLWLGTFDTAEEAALAYDKAAYKLRGDFARLNFPNLRHQGSHIEGSFGEYKPLHSSVDAKLQAICQSLAESQKQGGKAEKQSNSSAKKKTSVGTTPATAEKVKEAKAPQQVVPDKCCKVETPSSVLTESEASGGSSPLSDLTFPDLEEAPLDVDSGNFNLEKYPSYEIDWASLLSS

SEQ ID NO: 5480 - protein, 132 aa, Chelidonium majus
PRDRRMRLSLAIAKKFFSLQDMLGVDKASKTIQWLLMKSKPAIKELMNKIRFSQRKHMKDGGSMNGTCMLELISELEETALFNDDDEDPRGVFSEGKTTEHSPKEKRIRGSCKAAFHPLARESRAKARARAR

SEQ ID NO: 5481 - protein, 526 aa, Arabidopsis thaliana
MGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 5482 - protein, 345 aa, Zea mays
  misc_feature (238)..(238): Xaa can be any naturally occurring amino acid
MALEAVVFPKEHLAGTAKARSASSLACGFRTEEVEDNGGVVLQGEASDAPGAGAATTWECWDAALCPCSTPPAGAVEECWDDVRHRLSASPPLPPAPSAAVAAPSSGHGKAAAAARRRRRQRPKAVKNTEEVESQRRNHIAVERNRRRQMNEYLSVLRSALPPSYPQRGDQASIVAGAINFVKELEHLLQSLEAQKRRRQGCTEPPAPAPFAGLFTFPQYSTAATGVVAGSGDGAGSXAGACAAGARRGVADIEVAVAESHASVKVVTPRRPRQLLRMVVALQCLGLTVLHLNVTTTADQLVLYSLSLKMEDQCRLSSVDDIAAAVNDILGKISDERASRHLLAA

SEQ ID NO: 5483 - protein, 89 aa, Brassica napus
MISSLSRAIEYPAADGQERSDSPVKQELSKSDQLQQDQDQPRRKHYRGVRQRPWGKWAAEIRDPKKAARVWLGTFETAEEAAFAYDRAA

SEQ ID NO: 5484 - protein, 399 aa, Zea mays
  misc_feature (230)..(230): Xaa can be any naturally occurring amino acid
MDSMEDAVSGTAAQGDLAEVVARAGAMAAAASHHHHRRPPSPAAADHGHIVSAARATARSQIMLVPAAACYDDETRPAAACGDAVMFDAPSSSMAAAVGPYHHLSSSSAALAPAHGGYWLPPQQISQEHARDGGLDEPPVVTRISPVTTPPPPSHHHQIMNSRKNEVKKVVCIPALPPPASSRPGGGEVIPSDLWAWRKYGQKPIKGSPYPRSFSCLLFLKRIAVFFVAXGYYRCSSSKGCMARKQVERSRSDPNMLVITYTAEHNHPWPMQRNVLAGYSRPHTATHMSSNCKKKKNSCSVEPTSSWPTTTTSSPSSKNGNYECQQMTNMTMEENAAAGYVAYAIDDEECAAMHQPINCGSVQPSADEVFAELEELEPTTSPVNANIFSRGVTYEWHKF

SEQ ID NO: 5485 - protein, 131 aa, Swartzia jorori
RVRLSIDIARKFFDLQDMLGFDKASNTLEWLFNKSKKAIKDLTAARSSGGGSGSGSGDGIAKTRSLSSNSSECEEVVSSNLQGLNSADHESLIMAMGVADTSKERKYLKRAQKESPDSSNDRAKMKESREK

SEQ ID NO: 5486 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLHGNRWSLIAGRLPGRTDNEIKNYWNSTLSRKIGTAATAAAGSRGGSTPDTARATDAASSSSVVPPGQQLQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 5487 - protein, 644 aa, Zea mays
  misc_feature (338)..(338): Xaa can be any naturally occurring amino acid
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGALADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELXLKLNPGARPPASTGGIASAISFNTSSSEYDVDIIDECKGDEAGNQRTAVTDPTAFNLGAAILSDKFLVPTPMKEETADVEFIKKRNAPAAAEPELMLNNRVYTCNNVQCPRSDYSYGFLDRNARNSHQYTCKHKDPTPQSTENKPPSAPPQPQAFQPAFSQPNQALNSVDFSLPMDGQRSIAELMNMYDNNFVPNKNPSSDSVAVMERPNAMPQQRIQMDEGFFVQGNGAFDDVNSMMQQQQQQQHQAPVQQQQQFFIRDDTPFVSEMGDIAASAPEFRFGPGFNMSSGVDYSGAAQRNDGTNWFY

SEQ ID NO: 5488 - protein, 267 aa, Zea mays
MAAGGGGGSAAPFVWKTYTMVEDPGTAGVIGWGSGNNSFVVADPFVFSQTLLPAHFKHNNFSSFVRQLNTYGFRKVDPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLVGDAPVPDNGFASGGAAEPPAAEVGEKRARLLLDGDSMVALGPEAVDFAGFYSGGGAFGDVAVDAAAGSRGGGFSFAFGVDAGY

SEQ ID NO: 5489 - protein, 208 aa, Zea mays
MPTSASPTSTSTSPFEGESAPTSVLPDYAKKAVPDDRLAELALLDPKRAKRILANRQSAARSKERKIKYTSELERKVQTLQTEATTLSAQLTLLQRDTSGLTTENRELKLRLQAMEEQAKLRDALNDALREEVQRLKIATGQVPNINGNPFNGGLPQQQQQQVPSYFSQPQGMQYFSSHQGQHQHPNHHPQSSSNGGGQSLSDSMDFM

SEQ ID NO: 5490 - protein, 107 aa, Swartzia jorori
RVRLSIEIARKFFDLQDMLGFDKASNTLEWLFTKSNKAIKELASSGNNNSFSSSEECDEEEEEEEIDYDSSNDGVKDRKMKRAQKLEEQPAASNCGVRAKMKESREK

SEQ ID NO: 5491 - protein, 270 aa, Oryza glaberrima
MGRRACCAKEGMKRGAWTSKEDDMLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAATTTTVWAPKAVRCTRGFFFHDRETAPLAAAAPAPAGELGDGDDADCDYYCSGSSSAATTTSSSSFPAVVEPCFSAGDDWMDDVRALASFLDTDDAWNLCA

SEQ ID NO: 5492 - protein, 94 aa, Swartzia jorori
RVRLSNQIARKFFDLQDMLEFDKPSNTLEWLLTKSENAIKELARAKCCDTSSEPRSVDASGKSIASASKGRKLKWVQREEDVGVVQTKKESREK

SEQ ID NO: 5493 - protein, 269 aa, Oryza glumipatula
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGEDWMDDVRALASFLDTDDAWNLCA

SEQ ID NO: 5494 - protein, 120 aa, Echium plantagineum
ICTAQGVRDRRMRLSLPIARKFFDLQDILGFDKASKTIEWLFSKSRKAITKLLINNNLPPSNHRYLSDVEYVNPDDDDDEEEGDDEDDDDVKMEEIIEKEELSKSRKVMINYQNAKESRE

SEQ ID NO: 5495 - protein, 82 aa, Brassica napus
MQDQLVCHGCRNTLLYPRGATNVRCALCNTINMVPLHPPPPPPHHHAHAGMDMAHIVCGGCRTMLMYTRGASSVRCSCCQTV

SEQ ID NO: 5496 - protein, 491 aa, Oryza sativa
MEMACLPGNAMATDENGADDRAGGESTVDHLRSHMNYGDMDLSGEEHVPKARKPYTITKQREKWTDEEHRLFLEALQLHGRAWRRIQEHIGTKTAVQIRSHAQKFFSKVVRESSGSNTGSGGASAAAAAAAIQIPPPRPKRKPAHPYPRKVDGAAKKHVPALRQLEKPPLWMQSLSEQEEGSPTSVLTAAQVGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWLSYNGSLPCALFYPAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 5497 - protein, 106 aa, Echium plantagineum
AQGVRGRRMRLSLPIARKFFHLQDLLGFDKASKTIEWLLSNSQEAIKELQRNIHSQQATIDPKFMHDHFEAKSSTKDVEENRNNERVTKSRNSFYNNCSHAKECRE

SEQ ID NO: 5498 - protein, 219 aa, Zea mays
MATGGGGGSDDFHGLTFGQKIYFEQDAGAAGGSATGGRKGKGAAASASAAQPPRCRVDGCGVDLSAVKQYYCRHKVCYMHSKEPRVFVAGIEQRFCQQCSRFHQLPEFDQGKRSCRRRLIGHNERRRKPPPGPLTSRYGPLAASLVQGIKCHIILLCSYRCRHALHTLLVIFRCICQSAVSRIYCFFFGQSLVGSGASCSTSRTRGFQAAGEMMRGHGK

SEQ ID NO: 5499 - protein, 106 aa, Lithospermum multiflorum
AQGVRDRRMRLSLPIARKFFDLQDLLGVDKASKTIEWLFSNSQEAIKELERKNHSQGKENSVGKFMSDFEVKSGNNEVEENPNNENGIAKSRKFMFNYSHAKQCRE

SEQ ID NO: 5500 - protein, 107 aa, Lithospermum multiflorum
AQGVRDRRMRLSLPIARKFFDLQDLLGVDKASKTIEWLFSNSQEAIKELERKNHSQGKENSLGKFMSDFEVKSGNNNEVEENPNNENGIAKSRKFMFNYSHAKQCRE

SEQ ID NO: 5501 - protein, 156 aa, Physcomitrella patens subsp. patens
GRKPRGRPPGSKNKPKPPIIIMRENGQAMRPHILEVAGGCDVSDSVASFSRRRQRGVCVMGASGTVSNVTLRQPTTAGATITFHGRFEIISLSGAFLPHPSSQPTTGLTVSLAGAAGQVLGGSVVGTLMAAGPVVVIAASFMGPTFVRLPLDADDE

SEQ ID NO: 5502 - protein, 331 aa, Oryza sativa Indica Group
MARRAPPAGFFPLPPSLPFLPLLLKLLAELGKKVLSELEEENWDRRSMNHKASIKMVVAGKKQGRHSFSASSSSSSSSSCSVVQLGHHQRPQGEDPLIGIKAAAAGGGGIMRKGPWTEQEDVQLVWFVRLLGERRWDFLAKVSGLQRSGKSCRLRWVNYLHPGLKRGRMSPEEERMVVQLHAKLGNRWSRIAKSMPGRTDNEIKNYWRTHLRKLKLKQQKQQQSDDHHNDNDDDDDRNSSSSSSSSNSNSNLQQQPQPEDESSASGSLQAQHHEDQHQLFLHPLWNDDIIVDVDCWSSSTNVVAPPPMPASPLWDIDDAFFCSDYSLPLWG

SEQ ID NO: 5503 - protein, 134 aa, Lithospermum multiflorum
AQGVRDRRMRLSLPIARKFFDLQDMLGFDKASKTIEWLFSKSRKAIKKLLINRNLPPSKHSYLNGDYEYVNDDDDDDDDDDDDDEREEINEFVIPGDSNSNNEARNEMITYEKEEVSKSRKVMNNYKNAKESRE

SEQ ID NO: 5504 - protein, 54 aa, Cocos nucifera
YQWRKYGQKPIKGSPYPRGYYKCGSLRGCPARKHVERAPDDPSMLIVTYEGEHN

SEQ ID NO: 5505 - protein, 349 aa, Arabidopsis thaliana
MVKGTKRKIAIETIQKRDSLRVTCTKRRKGLYSKASQLCLLSDAQIAILATPPSSESDVSFYSFGHSSVDAVVSAFLSGKRPVSAPKDNKETREDVGICLTRKNLGLGFWWNDESLVRSENPQEISEAIGSMWTLLSNLKELRADEACVNDHKDLKKNEKSDVHGTQDQTLIFQSASAVCCIPENLNDITQEPNQTLDIQSSSSAICCVPDKSPEIFNEITEEQDQILSICETFCVTDNNNNNNNNAALPEVNLYYNQDMAIDQLIDFNTPFESSIDDWFSDNTTHQETTSASILNDVGVDDQVSVDTNPFSYFQSLEDADLVFQRCLDGDNLRFSDCFNDFANTIAAV

SEQ ID NO: 5506 - protein, 180 aa, Brassica napus
  misc_feature (135)..(135): Xaa can be any naturally occurring amino acid
MEAFGGFHKEDDEQMVLPPGFRFHPTDEELITHYLHNKVLNIDFSAKAIGEVDLNKAEPWELPYKAKMGEKEWYFFCVRDRKYPTGLRTNRATQAGYWKATGKDKEIFRGKSLVGMKKTLVFYRGRAPKGQKTNXVMHEYRLDGKLSPHNLPKTAKNEWVICRVFHKTAGGKKIPISTLM

SEQ ID NO: 5507 - protein, 287 aa, Dendrobium nobile
MDEMYGLQPDSAFAAAEDLHGLIAAAGYGAAAAAAAAEEEMKARIASHPRYPHLLEAYIDCQKVGAPPDIASLLEDIRRENAGGERVASSSVILGSDPELDEFMEMYCDVLVKYRRDLERPFDEATAFLNTMEVQLSDLCKPTCRPALGPYVSDEAVGSSDEELSGGEGEAPESHLKGEERDLKEKLLRKYSGYLSSLKQEFSKKKKKGKLPKEARQILFEWWTAHYKWPYPTEADKIALAEATGLDQKQINNWFINQRKRHWKPADQNMHFSVMDSSSTSSFFADD

SEQ ID NO: 5508 - protein, 213 aa, Petroselinum crispum
MIQTQKVDNRRMGNHKQKWTAEEEEALKAGVKKHGMGKWKTILVDPDFATALTHRSNIDLKDKWRNLGISSSAAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKL

SEQ ID NO: 5509 - protein, 55 aa, Helianthus annuus
LCGACGENYASDEFWICCDICEKWFHGKCVKITPARAEHIKQYKCPSCSNKRARP

SEQ ID NO: 5510 - protein, 129 aa, Capnoides sempervirens
PRDRRMRLSLEIARRFFTLQDMLGFDKASRTVEWLLTKSKGAIKELTRSIKGSSNTCGGSTSTSSECEVVSMYDHTTNVDNDDDENKVQISNTISSNSKEKRIRITRRPTFHPPPLAKDYRAKARARAR

SEQ ID NO: 5511 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 5512 - protein, 215 aa, Pisum sativum
MAREKIQIKKIENATARQVTFSKRRRGLFKKAEELSVLCDADVALIIFSSTGKLFEYSNLSMREILERHHLHSKNLAKMEEPSLELQLVENSNCTRLNKEIAEKSHQLRQMRGEDLQGMNVEQLQHLERSLEIGLGRVIENKGEKTMMEIQHLQRKGRQLMEENDRLKRHVTGMMNNGKIVGGVECENVVIEEGQSSESITNVYNSTGPPQDYES

SEQ ID NO: 5513 - protein, 242 aa, Corylus avellana
MEFQNQSMSVSPQRKLGRGKIEIKRIENTTNRQVTFCKRRNGLLKKAYELSVLCDAEIALIVFSSRGRLYEYANNSSVKTTIERYKKACADSSNSGSVSEANTQFYQQEAAKLRGQIRSVQDSNRHMLGEALSELNFKELKNLEKNLEKGINRIRSKKNELLLAEIEYMHKREVDLHNNNQFLRAKIAENERNQQNLNVMPGGGNYELMQSQSFDSRNYFQVDALQPNHHYPRQDQMALQLV

SEQ ID NO: 5514 - protein, 457 aa, Arabidopsis thaliana
MVKDLVGYRFYPTGEELINHYLKNKILGKTWLVDEAISEINICSYDPIYLPSLSKIKSDDPVWYFFCPKEYTSAKKKVTKRTTSSGYWKATGVDRKIKDKRGNRGEIGIKKTLVYYEGRVPKGVWTPWVMHEYHITCLPQDQRNYVICQVMYKGEDGDVPSGGNNSSEPSQSLVSDSNTVRATSPTALEFEKPGQENFFGMSVDDLGTPKNEQEDFSLWDVLDPDMLFSDNNNPTVHPQAPHLTPNDDEFLGGLRHVNREQVEYLFANEDFISRPTLSMTENRNDHRPKKALSGIIVDYSSDSNSDAESISATSYQGTSSPGDDSVGSSNRQFLQTGGDEILSSCNDLQTYGEPSISSSTRQSQLTRSIIRPKQEVKQDTSRAVDSDTSIDKESSMVKTEKKSWFITEEAMERNRNNPRYIYLMRMIIGFILLLALISNIISVLQNLNPAMKFDRER

SEQ ID NO: 5515 - protein, 494 aa, Zea mays
MELDLNVAEVAPEKPSAALEASDSGSSGSSVLNAEAASAGGGGPAPGEEGSSSTPAVLEFSILRSDSDAAGADADDGDATPSPPRHHQQQLVTRELFPAPQHWAELGFFRAGPQQQPDIRVLPHPHPHPPPPPPAQPQPAKKSRRGPRSRSSQYRGVTFYRRTGRWESHIWDCGKQVYLGGFDTAHAAARAYDRAAIKFRGVDADINFNLSDYDDDMKQMKSLSKEEFVHALRRQSTGFSRGSSKYRGVTLHKCGRWEARMGQFLGKKYIYLGLFDSEVEAARAYDKAAIKCNGREAVTNFEPSTYDGELLLTAEASAEVADDVDLNLSISQPASSQSPKRDKNCLGPQLHHHHGRPFDGSAVLKKTKIDAPSELSSAGRPHRSFLPHLVAAEHLPPRSHPFFITHHESDASRRDPSWAAAAAWKVTAAAPPPPTTTLLPLPLPSTSSAAASSGFSNTATTAAAAPSAASSRRFDPPPPSSSSSSSHHHHHHRR

SEQ ID NO: 5516 - protein, 373 aa, Oryza sativa Japonica Group
MGKGRAPCCAKVGLNKGSWTPEEDMRLVAYIQKYGHANWRALPKQAGLLRCGKSCRLRWINYLRPDLKRGNFTAEEEETIIKLHGLLGNKWSKIASCLPGRTDNEIKNVWNTHLKKRVSPEQKKGGGKSKKKTTCTDVLVPSPSPSSSTTTTTNCSSGDSAGEQSNTSKEEEEETDKIEIPMLELDPCCFDFDMLVDPVVPDTYCPAVSASASASASAQTSQCSSTSPSCARAGVDPLLDLPEIVDLGPELWSIMDGGAGDGCTEAPPPAWSNAAAAAAANATVATTTSLEEEEGKEWWLKDLEKELGLWGPTDDYHCHPGPQGQPGRAGPPPSAVVEDPVSCYFQAGPTAAATWQGHEPSAVITSNPMDYYV

SEQ ID NO: 5517 - protein, 133 aa, Lithospermum multiflorum
AQGVRDRRMRLSLPIARKFFDLQDMLGFDKASKTIEWLFSKSRKAIKKLLINRNLPPSKHSYLNGDYEYVNDDDDDDDDDDDDEREEINEFVIPGDSNSNNEARNEMITYEKEEVSKSRKVMNNYKNAKESRE

SEQ ID NO: 5518 - protein, 133 aa, Lithospermum multiflorum
ITSKGPRDRRMRLSLEVAPRFFNLQEMLGFDKASQTLEWLMNKSKWAIMELSKNTSTTTCVDANGALVISSTTSECEVISSSSNVVQDSEGFENLEGKNKSSSSCTKKWKKNGKTSRAIRPFAKKTREEARER

SEQ ID NO: 5519 - protein, 308 aa, Glycine max
MSTIAKRDLSSNEEESELRRGPWTLEEDSLLIHYIARHGEGRWNMLAKSAGLKRTGKSCRLRWLNYLKPDIKRGNLTPQEQLLILELHSKWGNRWSKIAQHLPGRTDNEIKNYWRTRIQKQARQLNIESGSKRFIDAVKCFWMPRLLQKMEQSNSPSPHHSSMTNMMNLGNSGEASMSSMSSSFNINPSMSSSSSPPQREFIMDDANHFNTMSNPINPSPDSFQFSQLLEISEHPKSPSNVFENNVCSYPIQDNCYVDTNNYGMEGINMDPLSAMDTYDFPQFDFQTAGNGWMLDSMGDSTLWNMEAM

SEQ ID NO: 5520 - protein, 85 aa, Lithospermum multiflorum
VTARGPRDRRVRLSIDIAKKFFGLQDMLGFDKASKTIDWLLTKSKSAIEDLAHKQTEQQGFVQVTTNVENGDLGEVEKFARELRR

SEQ ID NO: 5521 - protein, 87 aa, Lithospermum multiflorum
ITSRGLRDRRMRPSLEVAPKFFNLQEMLGFDKASHTLEWLLDKSQWAIIKLSRSSTCRDYANNTCTSSKCETNGKLMKAVENENTFC

SEQ ID NO: 5522 - protein, 426 aa, Glycine max
MSKPKTQRKPTITKHVSQNQNQEAQKTEKQPSWVVRGLLACRNVQIQQNQPQQKEAKSPPEAKENRKKQEHRKLQEERVPEENSKKSKKMKCSGSLCNNTKITAKPDTATPDVHKKRLLLSGCNNKNDASSRSMKAPLNELNGTVSASSSSLSASSTSSGGGSFRGMPFRRLSGCYECRMVVDPVLGFTRDPSLRSSICSCPDCGEIMKAESLEHHQAVKHAVSELGPEDTSKNIVEIIFHSSWLKKQSPVCKIDRILKVHNTQKTITKFEEYRDSIKAKATKLSKKHPRCIADGNELLRFHCTSFNCSLGLNGSSNLCNSIPQCNVCSIIKHGFKVTGGAGILTTATSGKAHDKAACVEESEEKRAMLVCRVIAGRVKKNAEGGMEEYDSVAVAGAVGAYSNLDELLVFNPKAILPCFVVIYRGF

SEQ ID NO: 5523 - protein, 127 aa, Medicago truncatula
MLANFWDVEITLPHNKHGSYTCPKCNKVISTSHKFGSDMASHYNSETQKERKKRYMSRIPKRPNLHIQKLNVGTTTFVRVVVSVDQSHAASVNYDNQNMSTPTSLVSEVKVKLKLADNENILCKFNL

SEQ ID NO: 5524 - protein, 149 aa, Glycine max
  misc_feature (91)..(91): Xaa can be any naturally occurring amino acid
  misc_feature (133)..(133): Xaa can be any naturally occurring amino acid
MLPEHQVTSLGRHFESDHDSAPSPVNVSVDKNMKDSKELVTVPEMDEELAMVPVHQKPKRSEIVQRRIRRPFSVDEVEALVQAVEKLGTGXDKWKTLVHTARISPQHRRGEPVPQELLDRVLVAHAYWSQQQXKSQHKHHPETETVFSF

SEQ ID NO: 5525 - protein, 366 aa, Medicago truncatula
MARSAKGHQDEELVDDDDDQDIFTPNTSSSINNNNNVKVDEPIRGKRANPHRSKHSETEQRRRSKINERFQALRDLIPENDSKRDKASFLLEVIEYIHFLQEKLQIYEHPYEGWNQEPTKLIPWRNHHGPSENTTDPSRAIQNGSVDGKNIVSPSFPKNVQNPILSDPSTTIPKGCTPGSSTEVVPLTMQMRLDMFDPVVSGGMVTQQMLELPVSNPDMASNLQPQVWLGKPNKDNHIVSDNTLKEQEEMKIDSGSESDSISSAYSQRLSIADSRSSNVVHCDMFTRILGTLTQALQSSGVDLSQTNVSVDIDVGRRTNTGFTPCQYSSKSNENQFVSNQAIACSGMDYFSEDSEQSSKRFRREAS

SEQ ID NO: 5526 - protein, 256 aa, Catharanthus roseus
EDEDEDRENGSGGEPKEGAVEIGTRRPRGRPPGSKNKPKPPIFVTRDSPNALRSHVLEVSGGSDVAESIAVFARKRQRGVCVLSGSGSVANVTLRQPAAPGAVVALHGRFEILSLSGAFLPGPAPPGSTGLTVYLAGGQGQVVGGSVVGSLVAAGPVLIIAATFANATYERLPLEDDEEDQVSPATGATTAGQPQLGGGGGGNSSSPPGMGSSGMGAHDPNSSMPVYNLNPNLLPNGGQLNHDGGYPNWAQPRTQY

SEQ ID NO: 5527 - protein, 238 aa, Triticum aestivum
MHCMFRGYYRCSSSKGCPARKQVERSRTDPNMLVITYTSEHNHPWPTQRNVLAGSTRSHYAKNSSNTDAASSKNSKNSSRNQHKPVVKAESKDQSAATPAATSTTTTATTSTGNNTPPMAVKEEAEMERRIGGDTTATVGYYSDHLLQQMFSQSYRPMMPEEAGGYHHQDDFFADLTELDSDPVSLIFSTEYMEARPGKEKAAAKDDVDSLFMMDWAPASAAVTTSAGSALEQGDMGL

SEQ ID NO: 5528 - protein, 284 aa, Triticum aestivum
MAAAIDLSGEDLVRALEPFIREASAPPPLHSHLSPTSPFSFPHAAYSGYPYGVQAQAQTELSPAQMHYIQARLHLQRQTGQPGHLGPRPQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPATTTAAEVPEMQQLDFSEAPWDEAACFALTKYPSYEIDWDSLLAAN

SEQ ID NO: 5529 - protein, 240 aa, Triticum aestivum
MAPRTSDKTATPPAAGAAATGLALGVGGGGNGGGVGPHYRGVRKRPWGRYAAEIRDPAKKSRVWLGTYDTAEEAARAYDAAAREYRGNKAKTNFPFASASAPPAAAALTGDGSRSSNSSTVESFGGDVQAPMQAMPLPPSLELDLFHRAATSTAGAGAGAGMRFPFSGYPVSHPYYFFGQAAAAAAGGCHMYSQAPKVTVASVSPSDSDSSSVVDLAPSPPSRKPVPFDLDLNCPPPAEL

SEQ ID NO: 5530 - protein, 364 aa, Glycine max
MVKSNENGSGSVSVPPFLKKCYDMVEDRNTDSIIRWSDGGDSFVISDITQFSVTLLPTYFKHNNFSSFIRQLNIYGFRKIDTDCWEFANENFVRGQKHLLKNIRRRKHPHSADQQKALPQQDNCDEPSQEAPYHGLWKEVENLKLDKNSLTQELVKLRQHQESAENKLLLLSDRLQGMEKHQQQMLSFLVMVVQSPGFMVQLLHPKENNWHLAESWNILDQDKQDDKPVASDGMIIKYKPPVGEKLKPVVPLSPGFEKQTEPELSAEGLKDLCVSSEFLKVLLDEKLSPLENHSPFLLPDLPDDGSWEQLFLGSPFMGNIQDSNKESEGHTNGGMEMEPTISETPNENSRTFESMIVEMEKTRE

SEQ ID NO: 5531 - protein, 245 aa, Pinus pinaster
MASTDPPADTVPAEPVANEDVKAAEEKPVKAPKEKKVKTPKEKKPKAAKGSKPPPAHPPYFQMISEAIVALKERGGSSPYAIAKFLSEKYKSDLPPVFKKKLNVQLRNLTNSGKLTKVKGSYKLAEKEKKADAPKPKTEKKPAAKKPKAPAAKAPAKAPSKASKPAAPKKAEKPVAPKKAAAPKKAAKPAAPKAAAPKAKKPAAAAKPAAPKRSSTRTAAKPAAPKAAKKPTPKKAGGAAKKAKK

SEQ ID NO: 5532 - protein, 278 aa, Brassica napus
MGRTTWFDDDGIKKGEWTAEEDQMLVAYIKEHGLGDWRTLPKRAGLQRCGKSCRLRWLNYLKPGIKRGKFTPQEEEDIIKFHSLLGNRWAAIAKQMPNRTDNDIKNHWNSCLKKRLVRSGIDPMTHKPTVNVAKATSSSTTSSPTPTPSSSSSTSSSFSSTGSARLLNKLAAGISSRKHELDRIKNVIMSKPRQAVEEDEMMIGSKEDEEVTGCSMEIDENLISMTSFDEFLTCDFTPTYTTGFVDAFGGYSLVEPYDLYQSDFYHETSDDQLDLFLL

SEQ ID NO: 5533 - protein, 748 aa, Lilium longiflorum
MVKELKVDDFFTDWDAKNGFELGWPQPGIDHPTNFGDSPNGSAHVSPNGSALVSPDASATSSNGNVSSSTSFEGDDVYADSEIFSDIVLSYINRMLNEEIIDEKLDIFQGHPELEATEKPFYEILGEKYPPPSDQPSMYNNPSPETPDSNIYVKSSSSNSINSVVTSGNWAFGAIELPQNYLIPVDYSSQSSFGSTNSVHNAIEGLGEPTMTNIEARDQFSESMLAEQFMRGVEEARKFLPKEDKLVINLEDNGISLPPKLMYDNGLNEVKEEEKEYTAYGSRGRKNRHSDELDLEEGRSNKQSAVDYTEETLRSEMSDLVLLCPNCDGKEGVSSKTWTQNEATRSPQNGHTRGSGSSKSRGKKPSKTEVVDLRTLLIHCAQTVAIDDRRSANDLLKQIRQHASPFGDGMQRLAHYFADGLEARLAGMGSEKYHSFVAKPVSATDILKAYGLYMSACPFKKVSFYFSTQMILDTTEKASKIHIVDFGIYFGFQWPSFLQRLSKRPGGPPKLRITGIDLPQPGFRPAERIEQTGRRIAEYARSFNVPFEYQGIAAKFETIKIEDLRIAEDEMVVVNCSFSLKNLADETVAEDCPRTRVLSMIRKLNPALFTLGVVNGSYNAPFFVTRFREALFHFSALFDMLEMNTPRKDEQRLLIEQNIFGRDAMNVIACEGTERVERPETYKQWQVRNFRAGFTQLPLDRDIVKKSKCKVKELYHKDFVVDEDGRWLLLGWKGRIIYALSAWTPNSR

SEQ ID NO: 5534 - protein, 538 aa, Physcomitrella patens subsp. patens
MDFLGKQSLDGSEEDRDIDGGAGSQTSPRVSSEDLSSESNTTSTTNAQDSAANGARTPGCRGKVRQYVRSRLPRLRWTADLHHCFKVAVERLGGHEKATPKMVLQLMDVKGLTIAHVKSHLQMYRSMKNDESVQSDIGYWREGHLHPTNLWLQATPERSRISDVLIHEQTAEIPMRSSSVKKQLETEWEMRRREYDARITFTMLMEGRVEYPAIITPTTRVESRSSTQLLKLLDGSGDSGPGRRRPSDVWTPFSELDFKNQQGCEIHKQQSDLTRPQTQRPTVQDSFDRYSYDHNSECNWRQNRYSTDPNSSLSLSRPHSWPGCTVPSQKGIILSHRSTAMATKPVPIVDFLSSPQSRNIGRKGAPGDGLRLHLTMSTGSGSEGHDEGPESLYRKKEEDVDLTLDLTIQELQFRSLSPTAQGRTISRRDPNHRCKRLASLVVAESQKADMLLSVYLSPNICESNLVARHGGDQRSLSQPSKLGYGYERITLKGPPPHLEADSFSCGLPVNRRSSSHSRTQLTAKYGTCIFTSRAEKDL

SEQ ID NO: 5535 - protein, 451 aa, Oryza sativa Japonica Group
MASMPQLEEKDSSDLAINKGPSLDLVKSPLMMNDASATVTAMQPNEGMEEFPVKVRKPYTITKQREKWTEEEHDKFLEALKLYGRSWRQIQEHIGTKTAVQIRSHAQKFFSKVVREPGSNNAIEIPPPRPKRKPLHPYPRKCANSGSDANPATAQLKLAPGSSSSGSDQENGSPISVLSAMQSDAFGSSVSNPSTRCTSPASSDDGNNIPTFTSGEDNNVPCEPTVIDPSQSHKEIDQDRKDVNNMSEEDSSEEEVQETSLKLFGRTVVIPDPRKRSSSDPKHESEEQISQPSNEEMLQASSSVGEIPAAYCAPNGWFMSYNSFPFQFGESAADARIPPLHVWWPYYGFAPISHPRGLSTVMQQTEGSDESDGVKSHSSESSSDSGENVQMTAPQSSRIVESLGAIYVRDSGSSFELKPSANSAFVRVKPSNSGDEEVIRGFVPYKRCKFQ

SEQ ID NO: 5536 - protein, 339 aa, Zea mays
  misc_feature (282)..(282): Xaa can be any naturally occurring amino acid
  misc_feature (293)..(293): Xaa can be any naturally occurring amino acid
MAAAIDMYKYYNTSAHQIPSSSPSDQELSKALEPFITSASSSSSSSPYHGYSSSPCMSQDSYMPTPSYTSYATSPLPTPAAASSSQSQLPPLYSSPYAAPCMAGQMGLNQLGPAQIQQIQAQFMFQQQQQQRGLHAAFLGPRAQPMKQSGSPPPPLAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTEGGGXESGSAGSPPPXAPPPTLAPPVPEMAKLDFTEAPWDETEAFHLRKYPSWEIDWDSILS

SEQ ID NO: 5537 - protein, 188 aa, Triticum aestivum
  misc_feature (144)..(144): Xaa can be any naturally occurring amino acid
  misc_feature (167)..(167): Xaa can be any naturally occurring amino acid
MTRRCSHCSNNGHNARTCPARSGAGGGGGGVRLFGVHLTSPPVAAMKKSASMSCIASSLGGGGSGGSSPAVGPGGDAARGGGEGAPGYVSDDPMHASCSTNGRAERKKGTPWTEEEHRLFLLGLQKLGKGDWRGISRSFVVSRXPTQVASHAQKYFIRQTNFSRRKXESSLFDMVPEMPMDESPDGAE

SEQ ID NO: 5538 - protein, 151 aa, Capnoides sempervirens
PRDRRMRLSLPIAREFFSLQDMLGVDKPSKTVQWLLTMSKSAIEELTISLSQRRRINNKYHTAVGTGSGSKSTTTVSSMSSECEVVSEIEETVTCNQEEADRGRLPDFSKRKSLESSPSTPNKGKKIKPTRKIAYHPLARESRAKARARAR

SEQ ID NO: 5539 - protein, 218 aa, Triticum aestivum
MGEVKEKEALAKVLEDHRKGSSDDDSPPPAGLDLNEGFSEASDDGEDGEENYDDDGGSTSEVAGGGRSSSNNNSANHESESSRGHRDKAEGSGERVPTVRQYNRSKHPRLRWTPDLHMAFLHAVERLGGQERATPKLVLQMMNVRGLSIAHVKSHLQMYRSKKIEHESSHERAAMSSVFSPMNFHMRRGDHPFHDMFFQRAAGSTLSSRFNDGGVFAP

SEQ ID NO: 5540 - protein, 146 aa, Sophora tetraptera
VTFSKRRAGLLKKAHEISVLCDAEVALIVFSNKGKLFEYATDSCMEKILERHERYAYAERQLEANNSETQGNWTIEYTRLKARIDLLERNHRHYMGEDLGSMSLKELQSLEQQLDTALKTIRTRRNQLMYESISELHKEEKVIQEQ

SEQ ID NO: 5541 - protein, 184 aa, Glycine max
ADSAMIMDGVKKAMAPDKLAELALMDPKRAKRILANRQSAARSKERKIRYTSELERKVQTLQTEATNLSAQLTMLQRDTTDLTTENKELKLRLEALEQEAQLREDLNEALKEELQRLRAQSTRLGAIGGNPSFGGIFNQLASQLAMQQLSNSAPHQQTQHQPQVGMPPPPSGQNHPNFMDFNQQ

SEQ ID NO: 5542 - protein, 474 aa, Oryza sativa Japonica Group
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELEYKKIIFYVDVLLGYRDSS

SEQ ID NO: 5543 - protein, 316 aa, Glycine max
LYCLYPSKSNLQFYMQGNAPGRIEVGGKPPEVKEKLPIKRSKGSASGGNLNMWITGKNNEPGKIPGESANGIHSKSGESASDGTSEGSDENSHNDSQLKSRERQDSFEDEPSQNGSSVHAPQNGVHNRPQTVVNQTMSILPISTTSAPGAVPGPTTNLNIGMDYWGTPTSSTIPALHGKVPSTAVAGGMIAAGSRDGVQSQVWLQDERELKRQRRKQSNRESARRSRLRKQAECDELAQRAEALKEENATLRSEVSQIRSEYEQLRSENAALKERLGDIPGVATPGKEDLRSGQNDQHVSNDTQQSGQTEVVQGVH

SEQ ID NO: 5544 - protein, 220 aa, Populus trichocarpa x Populus deltoides
MKGCELCGGSARMFCESDQASLCWDCDEKVHSANFLVAKHCRTLLCQVCQSPTPWKSSGSKLAPIVSVCESCFAVHKNKKKQLQDLNVMASDQESREAGNDYDESENDREFDDDDTDDDSDEYDEEEDEEEDGDNQVVPWSGLTASSSPSIAPPVASSSSSEEEISCAGGNGFLKRMRDSNVDLDSDVSLFFLFFHFFAIFFILFFRGHILIIEFVDLRK

SEQ ID NO: 5545 - protein, 505 aa, Arabidopsis thaliana
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTSYQGTSSPNISVGSSSRHLSSCSSTDSCKDLQTCTDPSIISREIRELTQEVKQEIPRAVDAPMNNESSLVKTEKKGLFIVEDAMERNRKKPRFIYLMKMIIGNIISVLLPVKRLIPVKKLHPAFLYKVGIIRKHCLSICATNRSLSVKINHY

SEQ ID NO: 5546 - protein, 512 aa, Brassica napus
  misc_feature (418)..(418): Xaa can be any naturally occurring amino acid
MSFNFNPSSSSSPPPPPDEGERGEEVKKMEEEEEDECVENKQSTAASCSSVSEGSGGGGGSSFLKSPPAVASPPTVSPTHRRTSGPIRRAKGGWTTEEDETLRRAVCTYNAKSWKKIAEFFPDRTEVQCLHRWQKVLNPDLIKGPWMQEEDEKIVELVKKYGPAKWSTIAKSLEGRIGKQCRERWHNHLNPGINKEAWTPEEELALMNAHRVHGNRWAEIAKVLPGRTDNSIKNHWNSSLKKKSEFYQANGALPPSAAKNGVLDSATKRPLFYQRRDSAIQINKPDEDGRHQLNSSVPLEEVVAASPLTNDQLPRPEPSPENGYHLYYKNHQTEYSMASEADKQRMYGYECGCSPSASPVIFFTPPPPSRKEYINGLRPTSPESYLREAARTFPNTPSIFRKRRRRTVVVSDSDNKAXKTDEEGTKEAVVVVVVDQKVNEISESPDIEEKESNDGSNAYNLSPPYRIRSKRTAVFKSRQLEFISPEEEKADDDTKSSEKDKVLDGGDSQLPV

SEQ ID NO: 5547 - protein, 405 aa, Glycine max
MYTHQQHQGKNIHSSSRMPIPSERQMFLQTGNGSGDSGLVLSTDAKPRLKWTPDLHARFIEAVQQLGGADKATPKTVMKLIGIPGLTLYHLKSHLQKYRLSKSLHGQSNNMTHKITINSGAATDERLRENNGTHMNSLNLAPQSNNKDLYISEALHMQIEEQRRLNEQLEVQRLLQLRIEAQGKYLQAVLEKAQETLGRQNLGAVGLEATKLQLSELVSKVSSQCLNSAFSDRLKEIQGFSPHQQTQTNQPNTNDCSMDSCLTSCEGSQKEQEIQNGGMSLRPFNVHTFMERKEVIEGPNLNNLPNTDLNWCDPVKKNTFLTPLSMHADKRSPSNLSMSIGLEGETENGSTIRTESVKPVADKVSQDYGLPSNYFAASKLDLTTEDNKDTKTSCKQLDLNGFSWN

SEQ ID NO: 5548 - protein, 236 aa, Triticum aestivum
MAPRTSDKTATPPAAGAAATGLALGVGGGNGGGVGPHYRGVRKRPWGRYAAEIRDPAKKSRVWLGTYDTAEEAARAYDAAAREYRGNKAKTNFPFATASAPPAAAAALTVDGSRSSNSSTVESFGGDVQAPMQAMPLPPSLDLDLFHRAATSTAGAGMRFPFSGYPVSHPYYFFGQAAAAAAAGCHMYSQAPKVTVASVSPSDSDSSSVVDLAPSPPARKPVPFELDLNCPPPAEL

SEQ ID NO: 5549 - protein, 506 aa, Oryza sativa Japonica Group
MCDYFLQRMEGEQAAGDLADIVLRAGGAAAAAVAGGGIPSTEWQLPPAEEEEEEPGLFPLPPSSSDGSGMSGADAFGDPFAGLPDPFGGDYPSSGGAAAAADFFDAVVAKAGFVDVGVLGGGGGGGCDGGGVDGGGGGSSLLGMSKPILPRAAMQLPSVSPRAIRPYPVMAGDTVKLGAPMAGGPCAFDGAAAAGLHMSSSPRGAVGGIKRRKNQARKVVCIPAPAAAGGRTSGEVVPSDLWAWRKYGQKPIKGSPYPRGYYRCSSSKGCSARKQVERSRTDPNMLVITYTSEHNHPWPTQRNALAGSTRSHHAKNSSSNSSSSGASSASKNNSSHSGYHHHHHQKPLVKAEPNDQSAAATTAATVPVKEEAAMVGTSSEALAKTTQKSMEDAAAAASATAAAVEHSDLMQQMFSQSYRPMIPEAAAGGHHDDFFADLAELESDPMSLIFSKEYMATNYKPAGDPAGKEMNAVDKGLDPAYMLDWSSTTVVTRAGGSSFMQGEGGL

SEQ ID NO: 5550 - protein, 236 aa, Triticum aestivum
MAPRTSDKTATPPAAGAAATGLALGVGGGNGGGVGTHYRGVRKRPWGRYAAEIRDPAKKSRVWLGTYDTAEEAARAYDAAAREYRGNKAKTNFPFASASAPPAAAAALTGDGSRSSNSSTVESFGGDVQAPMQAMPLPPSLELDLFHRAATSTAGAGMRFPFSGYPVSHPYYFFGQAAAAAAAGCHMYSQAPKVTVASVSPSDSDSSSVVDLAPSPPTRKPVPFDLDLNCPPPAEL

SEQ ID NO: 5551 - protein, 455 aa, Catharanthus roseus
SESSSTISIGNQISLHVDIPSTKNEQFQCEDDCLPKVRKPYTITKQRERWTEEEHKKFLEALKLYGRAWRRIEEHVGSKTAVQIRSHAQKFFSKVVRESTNGDSGSGKVIEIPPPRPKRKPLHPYPRKLVSPAKSGTATSQKLTQTVSPNISSPAEEHQSPTSVLSAPCSDTPGTTDSATSDGSESLSPISSVVGAKSVGFVLSELPDLTSETKRSPSSSQVNSSADNKSPSTSQVNNCANQADQLHLKLELFPQDNAFDKEGSVEVSSSQIFKLFGKTVLVIDPSRPSSSTPGAGKVQPSHQNDGKSNSTKVPLGESECLRRALPCKARGNLYPSSLQRECPDTLLCGPFHSLPWLMMYQGDSSASFVQVHSPIAIKAQPLLDKKELHRVQSCKGGSSTGSDAESESIETVEDKNIEVKFRELSQEGEVQKQKLPLLKPGAKQHHFSAKAILPV

SEQ ID NO: 5552 - protein, 246 aa, Triticum aestivum
MAPRAAEKAPVSPPTGLGLGLGGGVGVVAGGAHYRGVRKRPWGRYAAEIRDPAKKSRVWLGTYDTAEEAARAYDTAAREFRGAKAKTNFPFPSSSSSSPVAGAGGGGSPSSDSTLDSSGGGSGGCAQAPMQAIPLPPALDLDLFHRAAAVTAVAGGGMRFPFNGYPVAPRQPMHPYFFYEQAAAAAAAASGYRALKVAQPVTVAAVARSDSDSSSVVDLSPSPPAVTAHKAVAFDLDLNRPPPSED

SEQ ID NO: 5553 - protein, 443 aa, Oryza sativa Indica Group
MDFSCFQPHSGGCDDMPFDSYVQQNGHQELHLVDHPFNNVTDGHEYYSPSAGGSFLPFATYYDLGHEYYPQGGEKDAVVVDRASPTIRKASPHLPLFTPKSEVSHLIGGGVVGSYKAFEMNSRLIRRKRASGKSLKKANVVKGQWTLEEDRKLVKLVEQFGLRKWSHIAQILPGRVGKQCRERWHNHLRPNIKKDTWSEEEDIVLIQTHKEVGNKWAEIAKHLPGRTENSIKNHWNATKRRQFARRRSRASSKNPKSGTLLQNYIKSLGIGPIKSSVRQAPPESTAVSSSSPASTQKLAEVNGKIRPDSNPSNQMVTQGILTMDENSYIQTNSCEELLVSTYDDLCLDMCDHLFETKDETPYQVYNIDDDVDMNYIFNHIDYANKIGHEIDMEMAWDDDVLQDDESAGSSPLETPAGLAQINTVHVKEEMDLIEMVTRTQSCG

SEQ ID NO: 5554 - protein, 246 aa, Triticum aestivum
MAPRAAEKAPVSPPTGLGLGVGGGIGVVAGGAHYRGVRKRPWGRYAAEIRDPAKKSRVWLGTYDTAEEAARAYDTAAREFRGAKAKTNFPFPSSSLSPVAAAGGGGGSPSSDSTLDSSGGGSGGCAQAPMQAIPLPPALDLDLFHRAAVVTAVAGGGMRFPFNGYPVAPRQPMHPYFFYEQAAAAAAAASGYRALKVAQPVTVAAVARSDSDSSSVVDLSPSPPAVTAHKAVAFDLDLNRPPPSED

SEQ ID NO: 5555 - protein, 247 aa, Triticum aestivum
MAPRAAEKAPVSPPTGLGLGVGGGIGVVAGGAHYRGVRKRPWGRYAAEIRDPAKKSRVWLGTYDTAEEAARAYDTAAREFRGAKAKTNFPFPSSSLSPVAAAGGGGGSPSSDSTLDSSGGGSGGCAQAPMQAIPLPPALDLDLFHRAAVVTAVAGGGMRFPFNGYPVAPRQPLHPYFFYEQAAAAAAASASGYRALKVAQPVTVAAVAQSDSDSSSVVDLSPSPPAVTAHKAVAFDLDLNRPPPSED

SEQ ID NO: 5556 - protein, 338 aa, Oryza sativa Japonica Group
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQVDFCV

SEQ ID NO: 5557 - protein, 135 aa, Physcomitrella patens subsp. patens
MTQPTTKVPVGFRFHPTDEELVGYYLPKKVTARKIDLDLIRDLDLYKLEPWDLQGQYKLIAQTDYYFFSRKDKKYPTGNRANRATTKGFWKATGRDKPIHTKLQTLIGMRKTLVFYQGRAPHGVKTDWIMHEFRL

SEQ ID NO: 5558 - protein, 603 aa, Arabidopsis thaliana
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPLLYADVELCYIFCLFYVHIRAKFIHSFICFLIQLLIFLNSNQSPYLAATETKIAFSLPTNPILLDSHEERNGSIVTLNWDIVCKMWVPTLSSSSCSSDERDESSGEAALTPVYLNVYDLTPVNNYLYWFGIGIFHSGIEDFTCYFSYYSLLSLTQLFNFNVAHNLEYCYGAHEYPTSGVYEVEPRNCPGFIFRRSVLLGTTSMSRSDFRSYMEKLSRKYHGDTYHLIAKNCNHFTEEVCLQLTGKPIPGWINRLARVGSFCNCLLPESIQLTAVSALPERLEFSDEDESNSEASSVSDEEGSEQHLINVADREIVYLQNKPVRLTREEIP

SEQ ID NO: 5559 - protein, 651 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQVYLGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAEQRVGFAKPNSKRWCLSSQK

SEQ ID NO: 5560 - protein, 303 aa, Oryza sativa Indica Group
MQEPKHTDPAAMRGAHHRRARSEVAFRLPDDLDLGGGGAGAFDEIGSEDDLFSTFMDIEKISSGPAAAGGSDRDRAAETSSPPRPKHRHSSSVDGSGFFAAARKDAAASLAEVMEAKKAMTPEQLSELAAIDPKRAKRILANRQSAARSKERKARYITELERKVQTLQTEATTLSAQLTLFQRDTTGLSAENAELKIRLQAMEQQAQLRDALNDALKQELERLKLATGEMTNSNETYSMGLQHVPYNTPFFPLAQHNAARQNGGTQLPAQFQPPRPNVPNHMLSHPNGLQDIMQQDPLGRLQG

SEQ ID NO: 5561 - protein, 478 aa, Ipomoea nil
MPLEGVFIEPSSRSNPLPDLSLHISPPNNTISSSRPSSCINELVAAAAGFDLPTNHRRHRQTDNNTSTSAAAAVYPELSLANPTATAAEENRFLRTGREQQQQHQTLQTYPQPYHLQTHTFQQNNSNSNNSSCSQMSNINHGVSLLDVSDGLRPIKGIPVYQNRSFPFLPMDRENKDPSKMCFYPMPPPPPPTASISHSPSPFFNPVVDHLSLLNNPSPSSSSSSAAAAAAAYRRFNGLSSAYQLPHNQYGGVGIGATAASHHHHHHPHHDAPPSHGMMMRSRFLPKLPAKRSMRAPRMRWTSTLHARFVHAVELLGGHERATPKSVLELMDVKDLTLAHVKSHLQMYRTVKTTDKPAASSGQSDGSGEEDLTVLGSTAAGGGGIRLMDQRGHPAAAVADGSSEPDFPNSTTTTLWSNSSSSREAWLQTNSSQESNGLIRSSSFPTQQRCGHPIDDCEKNPSLEFTLGRPDWVQKERD

SEQ ID NO: 5562 - protein, 282 aa, Arabidopsis thaliana
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTMVEKVLKTEESYDVSGGENVESGLTAIDDWDLTEFLSMPLLSPLSPHPPFGYPQLTVV

SEQ ID NO: 5563 - protein, 124 aa, Cysticapnos vesicarius
PRDRRMRLSLEIARRFFNLQDILGFDKASRTVEWLLTKSKGAIKELTGSSNNTSGVSSISECEVASAFDNTTNFDDDDHENKVQINKNISGNTKEKRVRVGRKPAFHPPPLAKDYRAKARARAR

SEQ ID NO: 5564 - protein, 360 aa, Triticum aestivum
  misc_feature (167)..(167): Xaa can be any naturally occurring amino acid
MSDVTAVMDLEVGEPQLALPPGFRFHPTDEEVVTHYLTRKVLRESFSCQVIADVDLNKTEPWDLPGKAKMGEKEWFFFVHKGRKYPTGTRTNRATEKGYWKATGKDKEIFRGKGRDAVLVGMKKTLVFYTGRAPSGGKTPWVMHEYRLEGELPHRLPRTAKDDWAVXCRVFNKDWAAKNAPPQMAPAAGGAMEDPLAFLHDLLIVTDLFDDADLPMLMDSPSGADDFAGASSSTSSAALPLEPDGEHLTIKTELPVLHPQQQQSPNYFFIPATANGNLGGAGYSPYQAMGDQQAAIRRYSKPKAEVASSSALLSPSLGLDTRALAGADTSFLMPSSRSYLDLEELFRGEALMDYSDMWKI

SEQ ID NO: 5565 - protein, 584 aa, Arabidopsis thaliana
MMMFNEMGMYGNMDFFSSSTSLDVCPLPQAEQEPVVEDVDYTDDEMDVDELEKRMWRDKMRLKRLKEQQSKCKGGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 5566 - protein, 297 aa, Glycine max
MDRIKGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRKCSSTMIDDNTQPLKRSVSAGAAIPVSTGLYMNPPTPGSPSGSDVSESSLPVASSSHVFRPVPRTVKVLPPVETTSSSNDPPTSLSLSLPGVGVVDSSEVSNRTTEPIHFTPPMPHRSNTMPLLPMMTSVSATVMAPFNFSAEFRSVMQEMIRKEVRSYIELHNQNGMCFQAAVNDGFRNASVKRIGISRVDS

SEQ ID NO: 5567 - protein, 344 aa, Oryza sativa
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQAAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGELFVPPMPSSWSWDQLEGFFGILSPLSPHPQMGFPEVAVN

SEQ ID NO: 5568 - protein, 126 aa, Physcomitrella patens subsp. patens
VRVICTDPDATDSSGDEEDSFQLARNPHKRFVQEIQMESQSITEDEFSSDNEFNETETQSSHSADGKPQKYRGVRQRPWGKWAAEIRDPSKGVRLWLGTYDTAEQAAEAYDKAAREIRGPTAHTNF

SEQ ID NO: 5569 - protein, 420 aa, Oryza sativa
MAQDASDAVLPASRIMADRHLSLPRKIMPEDAAVRAGESRPRPRYPERSVHLLSFAMAGLIPPFSGLFHEVLDFYEIHALHLAPNVVMTLAIFAHLCEMFIGVRPTMRLFQSFFVPQLLQGPSPVSGEGRRWAPLKDKLWFSFQAKAQKLASRWWDEGRLSLPVTAADPSLGLGNNDTTGAGDDDMASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 5570 - protein, 281 aa, Oryza sativa
  misc_feature (69)..(69): Xaa can be any naturally occurring amino acid
MAAAIEGNLMRALGEAPSPQMQKIAPPPFHPGLPPAPANFSSDGAHGFPYVGPVLLSQAEIQRCQTHIXHWRGRPHSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 5571 - protein, 890 aa, Arabidopsis thaliana
MEDDGGSDGGEGNGGFSPNSSFGAFADTAMDLDFMDELLFDGCWLETTDSKSLKQTEQSPSASTAMNDNSPFLCFGENPSQDNFSNEETERMFPQAEKFLLEEAEVGKSWWIAPSASEGPSSSVKERLLQAISGLNEAVQDKDFLVQIWVPIQQEGKSFLTTWAQPHLFNQEYSSLAEYRHVSETYNFPADEGMKDFVGLPGRVFLQKFPEWTPDVRFFRRDEYPRIKEAQKCDVRGSLALPVFERGSGTCLGVVEIVTTTQKMNYRQELEKMCKALEVYSDFYCAALPEIKDFLATICRSYDFPLALSWAPCARQGKVGSRHSDENFSECVSTIDSACSVPDEQSKSFWEACSEHHLLQGEGIVGKAFEATKLFFVPEVATFSKTNYPLAHHAKISGLHAALAVPLKSKSGLVEFVLEFFFPKACLDTEAQQEMLKSLCVTLQQDFRSSNLFIKDLELEVVLPVRETMLFSENLLCGAETVESLTEIQMQESSWIAHMIKANEKGKDVSLSWEYQKEDPKELSSGRENSQLDPVPNNVPLEAEQLQQASTPGLRVDIGPSTESASTGGGNMLSSRRPGEKKRAKTEKTIGLEVLRQYFAGSLKDAAKSIGVCPTTLKRICRQHGIMRWPSRKIKKVGHSLKKLQLVMDSVQGAQGSIQLDSFYTSFPELNSPNMSSNGPSLKSNEQPSHLNAQTDNGIMAEENPRSPSSSCSKSSGSSNNNENTGNILVAEDADAVLKRAHSEAQLHNVNQEETKCLARTQSHKTFKEPLVLDNSSPLTGSSNTSLRARGAIKVKATFGEARIRFTLLPSWGFAELKQEIARRFNIDDISWFDLKYLDDDKEWVLLTCEADLVECIDIYRLTQTHTIKISLNEASQVKLSGSFGNTGLS

SEQ ID NO: 5572 - protein, 280 aa, Vitis vinifera
MECLLFRLVLVIIFLIHVTFNFLSIEIVYIATISETNMLLDEIAMFQRIWSEEDELGILKGMIDYSAKNGSVPYPNGDMNEFYDFVKNTLHGDFSRVQLTDKARRLKKKYSNNVSRAKLGEDPTFQKPHEQRAFELSKKIWGGEGNSVGVQQSNKANGKARKNQKPNKAVKVEDVEVLSVINGDDKEAVKLENEPKSEPPKKYSLVVSDFTRINESVGMSSSMDRAIEIGLGLLSEPVKAELKEKWKELEDEEFQLYMKKLDLIQMEARVSMQAYRAKHQ

SEQ ID NO: 5573 - protein, 219 aa, Triticum aestivum
MAPRAAEKAPVSPPTGLGLGVGGGIGVVAGGAHYRGVRKRPWGRYAAEIRDPAKKSRVWLGTYDTAEEAARAYDTAAREFRGAKAKTNFPFPSSSLSPVAAAGGGGGSPSSDSTLDSSGGGSGGCAQAPMRFPFNGYPVAPRQPLHPYFFYEQAAAAAAASASGYRALKVAQPVTVAAVAQSDSDSSSVVDLSPSPPAVTAHKAVAFDLDLNRPPPSED

SEQ ID NO: 5574 - protein, 333 aa, Brassica napus
MTKKKLTPLEDPPTASSTDDDQVEALSGDDEKEQISDDSSSDHLMNPVAIPSAKRSKSEKPIAVTKPKAVKKRPIETTSVSAKRARIAEEAKKPSSFQRLWSEEDEVSLLQGMIDFKADSGKSPYEDMDRFYELASKSISFEASKIQFVDKIRSLKRKYMGKAKHGAESLTKAHDIDCLKLATCIWGLALDSNSSAKKLGKEEEEEVVAPESANGDKVEEDREVLVSGDNGGEDREVLAGGDKDKEVLINGGGASKSHGVRADDWFEDSFLVGSIAGLGVSEQFVKQKWSMVTVETKKRMEEKWKLLQAKEMELVLHKTDFMREIGSVIAEAS

SEQ ID NO: 5575 - protein, 216 aa, Zea mays
MAKTKQGKRDVDAYTIKGTNKVVRVGDCVLMRPADTDNPPYVARVERMESDGRGSVRVRVRWYYRPEEAKGGRRPFHGAKELFLSDHFDTQSAHTIEGKCIVHSFKSYTKLDNVGPEDFYCRFDYKAATGAFTPDRVAVYCKCEMPYNPDDLMVQCEGCKDWFHPSCMGMTIEQAKKIDHYMCSDCAKENGAKRPSNSYSVSPNSDSKIESKRRKR

SEQ ID NO: 5576 - protein, 397 aa, Zea mays
MAMVPCGHDTDWCHVLDNFNLLLCSSSCSPNAMANRAEDCLPISAAPPGPGHHQSCCKNEVVLEASCDGAFAAADCLSSALTNLQREDDSFYLPMYSAPPAVGDEYFSDLLAPDADGIDEALLMPFSDIDLQVFDSDDEHRPPVDQMVNMIPPAVLHHPSTAGTQNGGAVHAHQKAMAVIDDSCFRRGASGVEMAVVRHHGEPRQGSSSVAPVPPPSLPGTRARRSDGRSARAGKTTKLDYIGFDELRKYFCMPITRAAREMNVGLTVLKKRCRELGVARWPHRKMKSLKSLMANVQVMQEMGNVMSSVAVQQELAALETYCTLMEDNPWIELTDRTKKLRQACFKERYKRRRAAEVNVMDMDRIYCFGQHHHQQLLPPTTSSSDDRHGQCSRSFGY

SEQ ID NO: 5577 - protein, 140 aa, Vitis vinifera
MSRKTATHTTESDRKHCNCKRTQCLKLYCDCLAAGVYCTDSCACSNCLNKSENEGVVQIIREKIESRDPLAFAPRIVNPDTDTSEDGNWTTPSSARHKRGCNCKKSMCQKKYCECYQAGIGCSDGCRCEDCRNSFGIKAG

SEQ ID NO: 5578 - protein, 308 aa, Glycine max
MSSGTTYWCYTCRQPIWLEGREGFCPYCDGGFVQELNEMRGVARQHGFSTRMEDVHQMPDIMDAVRAVMEQRGSEPSIRVRDAVDNFMRQRMAGRYTNFDVRRRSDSGSGSGSILIPDETWGVFSSGPYLIFHGQAPGFTNSNGSSRGGPRGVDFGDYFLGPRLEGLIEQHISNDRLGPPPALRSSIDAMPTIKITHEHLESDSHCPVCKERFELGSKARKMPCNHIYHSDCIVPWLVLHNSCPVCRVELPPKEHTSSRGRRIWGGRNGNDSGSDNDISRGRENTQMNNGRRNLLSYLWPFRSSSSST

SEQ ID NO: 5579 - protein, 1062 aa, Oryza sativa Japonica Group
MPPPTVPFFLTSTTLAAAAAKPQRPGPPSPPAQKQQPREARDGSRDACASYTRAHAAQPRSLGSACSTTCSGSGADPDHVAYALALGRCARGRDRRAAAQLHAHAAKRGAASHRRVCNGLIHAYAVCGSLLDARKVFDRGHEGDAVAWNSLLRGYAAAGDVNALREFFVGMQARDTVSWNTIIAWCVENGEYEEAIAVFREMLASMECLPDRVTLVSVISAITYLGALAQGLWAHAYVCRKGIEVEERLSSALINMYSKCGCIEGAVHVFENLGAQMNVDTWNAMLAGFTANGCSEKALELFARMEITGLVPNKITFNTVLNACSHGGFVEEGMGCFERMTKVYGIEPDIAHYGCMVDLFCRAGLFDKAEKMIQMMPMKPDAAVWKALVGACKTHRNFELGRKAGHMLIEAAPNDHAGYVLLSNIYALDGNWTGVHKVRKLMLDRGVQKVPGSSSIEIDGVIHEFISGDKSHSSKEDIYEMLSEMCQQLKVAGYVPDTSHVLLDIDDEDVKESSLALHSEKLAIAFGLISTAPGTPIRIAKNLRVCGDCHNAVKLLSKIYGRNPLLLLAPDGPLPTARLLEKASSRADKQMPVRVGSVRDANMLCSAGYYYALGIRSLEPRLGDSMDMSESSEKGMESNASSGPGNGIPVEWQSQFSSAFACQPSVAAQHQQHAMMDSFAAASAGLWASSDVVSAMSSAAPPRGAGFLAPVPGFLQQGLGHFPVDSGFIERAARSTCFGGGMMAGGPYGAADQAMGDAFGGTAEGLMDHHRNVGNDKAEEFAGNGHDEVPSSEVAGGDCSSKGSDSKKRRRPNEVMGTDQVHSSNLPSDSANESVHSKDKGEESSPATTNGGKSKGKGAKETSESQKEEYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSIGFSPEMMHPQLQLSQPGLIHGGTAGMANPDVFRRIIQAQLGAKDGSQASHQLPNIRIKFSQNHQNSQSISPTSLQIHLRITSDILHSENPVH

SEQ ID NO: 5580 - protein, 273 aa, Triticum aestivum
MSGAGGMECSGSGGTVAPFVAKTFAMVDDPATDAVVRWGPASNSFVVADPFTFSHALLPAHFKHANFSSFVRQLNTYGFRKVDPDRWEFAHASFLRGQTHLLPRIVRRRSGGKGGKEDADGEEDEDISSKMLAMEVVRLKEEQRATEDRLAAMWRRVQDAERRPKLMLAFLLKVVGDPDVLRRLVGNSSCGGGLFPGEGAEAKRPRLLLDGEGQVSKKKMRVDGDGLLCGINRQEAFVREPRVDFTGFYTGGDGFSEVPVDDPPYAFPVDTGY

SEQ ID NO: 5581 - protein, 122 aa, Brassica napus
MQDQLVCHGCRNTLLYPRGATNVRCALCNTINMVPPHPHPPPPHAHAGMDMAHIVCGGCRTMLMYTRGASSVRCSCCQTVNLVPATPPTNQPAHVNCGNCRTTLMYPYGAPSVRCAVCQFVT

SEQ ID NO: 5582 - protein, 155 aa, Cysticapnos vesicarius
PRDRRMRLSLPIAREFFSLQDMLGVDKPSKTVQWLLNMSKSAIEELTISLSQRRRITHMYHTGAGTGTGSGSKSTTTGSSISECEVVSEIEETVVAHEEEEAHDQRLLDFSKRKSLESGPSTTPNKGMKKIRPSRKTTSHPLARESRAKARARAR

SEQ ID NO: 5583 - protein, 415 aa, Vitis vinifera
MVKSTEAGSVVPPFLKKCYEMVDDEASDAIISWNLSNDSFVIRDTTEFSHQLLPKYFKHNNFSSFMRQLNIYGFRKIDTDHWEFANEGFIRGQKHLLKNIRRRKQLQGQDKQKSSHQRDKSAGACEEIEASKLWNDVEILKTDRNALTQQLVKLRQHQETAESKLLVLRERLQGMEKNQQQMLSFLVMAMQSPEFLVQFMQPKEKNWRMAEVGKNMLERRAENGEPAASDVMIVRYQPPMDETPKPLPIPTSNSEKSLESDGMIVRYQPPMDETAKPLLMAKSNSEKSLESDFFMNIDFMKILMDGNMGSSEHQEPLILPDLPDDDILDQLLLENFADAKLDNQQAPIDSGMVMDPTVNQTQLDEPQHFELLNLEQKMPLKRMEKPYELEVESTLHGTRFEKSQHSELLTEQMGQ

SEQ ID NO: 5584 - protein, 349 aa, Solanum tuberosum
MGVQEKYPLLQLSLPPGFRFYPTDEELLVQYLCKKVAGHDFPLQIIGEIDLYKFDPWVLPSKATFGEKEWYFFSPRDRKYPNGSRPNRVAGSGYWKATGTDKIITSQGRKVGIKKALVFYVGKAPKGSKTNWIMHEYRLFESSKKNNGSSKLDEWVLCRIYKKNSSGPKPLMSGLHSSNEYSHGSSTSSSSQFDDMLESLPEMDDRFSNLPRLNSLKTEKLNLERLDSANFDWAILAGLKPMPELRPANQAPGVQGQGQAQGNVNNHNNNNMNFLNDVYAHPTTNFRGNTKVESINLDEEVESGNRNRRIDQSSYFQQSLNGFSQAYTNSVDQFGIQCPNQTLNLGFRQ

SEQ ID NO: 5585 - protein, 273 aa, Solanum phureja
MPIEALKSPTAALPPLEEIDDSHNLDSWAKGKRSKRPRIDNPPTRDQYLALCLLMLANDDGTGFGKGKGKGTGSIDVVIEQQQEKKLKPVFIKEKTEQLFKCSECPKVFTSYQALGGHKASHRKINVTATGDDDNNPSTSTSTSGGVNISALNPSGRSHVCSICQKAFPTGQALGGHKRRHYEGKLGGNNRYISGGGCGEGVHSGSVVTTSDGGSGNGGAASTPIARDFDLNMPALPGWQLDLTIDCGGRSQFPIEQEVESPMPAKKPRLFFD

SEQ ID NO: 5586 - protein, 276 aa, Saccharomyces cerevisiae
MGTSIVNLNQKIELPPIQVLFESLNRENETKPHFEERRLYQPNPSFVPRTNIAVGSPVNPVPVSSPVFFIGPSPQRSIQNHNAIMTQNIRQYPVIYNNNREVISTGERNYIITVGGPPVTSSQPEYEHISTPNFYQEQRLAQPHPVNESMMIGGYTNPQPISISRGKMLSGNISTNSVRGSNNGYSAKEKKHKAHGKRSNLPKATVSILNKWLHEHVNNPYPTVQEKRELLAKTGLTKLQISNWFINARRRKIFSGQNDANNFRRKFSSSTNLAKF

SEQ ID NO: 5587 - protein, 320 aa, Arabidopsis thaliana
MALEAVVYPQDPFSYISCKDFPFYDLYFQEEEDQDPQDTKNNIKLGQGQGHGFASNNYNGRTGDYSDDYNYNEEDLQWPRDLPYGSAVDTESQPPPSDVAAGGGRRKRRRTRSSKNKEEIENQRMTHIAVERNRRKQMNEYLAVLRSLMPPYYAQRGDQASIVGGAINYLKELEHHLQSMEPPVKTATEDTGAGHDQTKTTSASSSGPFSDFFAFPQYSNRPTSAAAAEGMAEIEVTMVESHASLKILAKKRPRQLLKLVSSIQSLRLTLLHLNVTTRDDSVLYSISVKVEEGSQLNTVEDIAAAVNQILRRIEEESSFS

SEQ ID NO: 5588 - protein, 544 aa, Glycine max
MVLKKRVDHGFDGLRVPVIPKAPRSARRRIAFKKAVEDGQVCAIELLASLAGQLLQESEGSASSNASEGNHHPPFSQGVIEQDIQDGVKPLKKEEIHQGSCVESTFKTEVASQNSSQKPLSHTKTGHVSVNNSSDCCEKAEADVKSEIFEWDNKFGNYSNRLVETREKFRVSTHGNIKNGFKWEQEAGSSCIRGSNLADKCSLEDHLELYVSPALIDSKSNIKSPFHRKFFPSASFSRYGNGIKLGFRDDDENFLRCKKFCTKPKAFRSPRRIAHRRIRNLMSSKYWKTAPKLKDSELSRSDLGVPRYHKRKTCYGFERSQHNAIVKKRKFVDRVSGVTSDGGFSSESVSNSPQKGMDGDKPSSSAKLHVPKAKDSHVKFSIKSIRIPELYIEVPETSTVGSLKRTIVEAVMAILGGGAHVGVLLQGKKVRDDNRTLVQTGISCNENLDTLSFMLEPTSLQASPTVCVGDPSSQCETSQPTRSTEIPVLDSGITDTLHDSPLLTYPGNLIESNHESTSSLADTTLDKLTPDSRAIVVVPTTTET

SEQ ID NO: 5589 - protein, 126 aa, Vitis vinifera
MITDSQPNKAEQLKRSCADCHTTRTPLWRGGPAGPRSLCNACGIRYRKQRSALLGLATGRGEKNKKKINRTSGNSELVSVKLRLMALGRDMVLQRRLGSGKQRRKLGEEEEAAILLMALSSGSVYA

SEQ ID NO: 5590 - protein, 220 aa, Capsicum annuum
MESEHEKSETPNFKRPLKKKCENAKRFTDEQVKLLESMFKLGTKIEPREKLQLARDLGLQPRQVAIWFQNKRARWKSKQLEHEYRILQSKFDHLNTQFESLKIEKERLLIELETLNDQLGNKLARGSKSQDSRDSELHTSPENGFTDLLELKHCAGCSNSRFGHKSVNEEDDETTEETDKYFTPKEEAEFWNLDELGDNNSLEHWCVGLGSISNSKLWDF

SEQ ID NO: 5591 - protein, 541 aa, Oryza sativa Japonica Group
MSSSASPAAWWARSRVRILLPVIFLAPALYFLLSPPSSPPFFFTLPTSREESPSASGSRVIWAQRRVAEWRSCGWWRAAMPAPSRRNGYIRIDCYGGLNQLRRDLCDGIAVARLLNATMVLPKFEVAAYWNESSGFADVFDVDYFIEQTRGYVEVVKDMPEEIASKEPFKVDCSKRKGHFDYVETVLPALLEHQYISLTPAMSQRRDSAIEAARGEDRKALTAIKGTRVDRLREASDTGHHRGRHKRARSSPPRHDDEPPPPPPLSPAVTGGAHGGAAWHSTVLAEDVESAVIVAALTHVISSTAAEVTTAVPPVTVAPQRAATATMFGQQVMQQPPRGFPPLPSSSGSAATAPEQQQPRRRYRGVRQRPWGKWAAEIRDPVKAARVWLGTFDTAEDAARAYDAAAVRFKGSKAKVNFPDEVAGASIAAVQLPRHHQHHPPTSLPPLPVPAHLRPHFSLAGGQSTTPAPAAAAVAAPPREEFPDLSSYAHILQSGDLEYDFHAAVSAGLTTTAGRSSSSSSLSMPPPSEDLDYKPPFGPSN

SEQ ID NO: 5592 - protein, 284 aa, Triticum aestivum
MAAAIDLSGEDLVRALEPFIREASAPPPLHSHLSPTSPFSFPHAAYSGYPYGVQAQAQTELSPAQMHYIQARLHLQRQTGQPGHLGPRPQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNGKKSASVSASTAAATSSTPTSNCSSPSSDEASSSLESAESSPSPATTTAAEVPEMQQLDFSEAPWDEAACFALTKYPSYEIDWDSLLATN

SEQ ID NO: 5593 - protein, 146 aa, Cysticapnos vesicarius
TRDRRMRLSIPIAREFFSLQDMLGADKPSKTVQWLLTKSKSAIEELTISLSQKRGINNKHQTTVAVATVSGSKSSTMSDCEVVSEIEETTVAYEEEAHDRRLLDFSKRKSRESSPNKGKKIRPERKTTYHHPLARESRAKARARAR

SEQ ID NO: 5594 - protein, 1641 aa, Chlamydomonas reinhardtii
MSELAGLSAEEAALINDVLTRLSIGHNAQAVPGLRAPHVSQHSADPELAELELAEQAIEQELRGLDNGTAPSSARASLAALSTYPYGGAQQPPAGVFAGAGAHRSTLPYSSPRDHVVAGVSAGAGGAGGGPAVMGAAAATPAASTASMAVGGARRVPMPGSAEAARAFTMLNARTSVDKYGHQANISAPFSASKVPVKLPEQERVTRLQQLYERTSQWRRRCEERYAKIKHDLESSALEGCTFSPQICTASNLIMQGKPPAEVYHELSKWATPTKHQQKPMGAHDRPYMAGASTAASSAYSTPARGTAPAKARNVSANNTPAGFRQSRATGSSGGGAAAQDSARGGGVSSSSPTPSKVVVNGPEVGMRMYNRATEQRLRQEERVLRQMLEEEQQRCFTASLQGVKPRVYNPPEPPSSRFLPTGMEECTFHPKTRYRVHSSRPGEEGDPAMQQRFDGPGQHFPPSARKLDTTTRSHRHDVNSSTASLRSSSPGQSTSRPKSAPHARLGTSSSGQRAAPPGRNDASSTSRSQAFSNMSTMGGSVHSTVSIRPDLDWGEFLARQERFLADREHKLALLEQEDALVPHMSPGSRRLLKEKEIRDSVAREEGHEEAGVAAQPSSNTAGSPGRLERKMQTIMEMYRECTFQPQITRKAAAMPNRSVDEMMDGGRSRRDEWLEQQRAVQQMRELEGATFKPQTNTKNNYAHVRPRINMRNPDAYLAHVDIKRRQREELRHELEREREALELQHCTFKPQEQADEAAWGQADAAQGFAADSGGMQHQGEGAEEAEGVGADGGYSQAVAGYDPYLYGDLPAAREPNYAGMGEDPGISELDPEYQAAYQRALAFAMNQGQRPCPLRHSLLGKATASRTWTCSYLRYSRMEQLGVSMRRAAQEGSRGKAVCLGRGQRTSNYRGRRVQALARQGKGKLEALLEKQALAQAPLLLRPWPALRQKLGLSGGAGGSSTDGDKKSGRAGGLPRPPPLTIPADVPSNIITGINAIGGATGMSPLPSILNSLNSPLLSASDNAQLQAMFQQLAQSTRGGQTPGLLGALTPGTAGAWPDSTKSGGGTLRQLLEMQDGLGDLGLGDMSDIDEAALADALFSKGFLGPLSARRTVTEYLSRLASGNNLLGGPLSPGGAGLSPLFSALSPAGGGGFTALLLPTPREPGNGGAGAHLLPSPTGFGRGGLGQGQDAPPPGAAGQAQGLEGDDDGGQVALHGVEFKPEEGKWAAVINDGEHTEVVGLFDSNIEAARAYDQEALRRLGPKAELNFPLEALSAAVAGLTGGQPLPLGLPGGGLLDPNLAAAGGFDAVQQAAMALGLTGLASGMQGLEGGIIGPDGKKESVYRGVVWDEKENKWRAQIVENNGINYLGYYDTQEEAARAFDGAVLRTGSKELLNFPLVPNACSKWVAVLWDRELKRARHIGSYESEEDAARAYDKEALRMLGPEAGLNFRESAADYLAEIGADGMPEGSHNSNKGSSQYRGVSWHERSQRWEVRVWGGGKQHFIGSFTEEVEAARAYDRAVLRLRGQDARSRSRMNFPLSEYNMDDLGPMPGADAGFLGLMGGLRSTPEPKPKKAQRKKRGRDDDYSDSDDDGMPVRGHYGSGGGAAQSAAAANRAAQQQLTAFLQTALQQQLAAGGGP

SEQ ID NO: 5595 - protein, 389 aa, Oryza sativa
  misc_feature (319)..(319): Xaa can be any naturally occurring amino acid
  misc_feature (335)..(335): Xaa can be any naturally occurring amino acid
MDMMEEEAANAATAQAAAAGDLADVVARANARAFLVSTPHHHPSPLHPLPPPPMPQAPHQYYPAPQITIPYHHHHHGELRRPTTIAYTDAPVPFETAGPPSTVVDSYHHLTPGDAGYGMPRPLALQISQHALCGGGDVVMGGGGAGAADDGEEAIRISPLTPSAHHQMMKRKNEVKKVVCIPAPPATSSRGGGGEVIPSDLWAWRKYGQKPIKGSPYPRGYYRCSSSKGCMARKQVERSRSDPNMLVITYAAEHNHPWPMQRNVLAGYARSHHSTHATASSSRHKQQQQQQTNQLQPALITSSSSSSSSPFNLYADVVXLGGQQANMMMTTEGAXGAGLGIQPSAADEVFAELEELEPDNPTMINANMQVYSTTSRPGVSSYDHQWHKF

SEQ ID NO: 5596 - protein, 391 aa, Zea mays
  misc_feature (147)..(147): Xaa can be any naturally occurring amino acid
  misc_feature (204)..(204): Xaa can be any naturally occurring amino acid
MEAADLRWCCGSSSNDWDLHAVVRFASCSGGGSRVTTSSPLRASDEPFSSCLLPPPQSQTKDEVTDAAAPQQLPTGPAVGVDDLCLQQAFLGLATPQPRNNEAPPPAKRPRTPYRSNNGVGGPTRSKRKYVSARRRRPAAHLNLYFXSIISSRNTGSTCLPGREGNDFSSRLYSYFRRKKKSQTSKKEVARVPVGASPDPWAWXRKYGQKPIKGSPYPRGYYRCSTDKDCRARKQVERCRTDPSTLIVGYTGEHSHPVPLHRNALAGTTRNKPQPAPPSTSSPAEQPDPAASPIDDTTTPLLCPSVLGVECEEEEENTVAAGLLLEDAEMEGYEDVLLFLKPAPSPSNGSGSKDVMLFPDPHRPAPGADNTGGSEKVVPLSNLQSTSYHFQ

SEQ ID NO: 5597 - protein, 208 aa, Boechera stricta
MATIEESSDLEAIQKHLFEDLMVSDGFMGDFDFDASFVSELWCIEPQVPKQEPDSPVFDPDSFVNEFLQVEAKSSPELNSSSSTYETDLSVKKAERFEEEEEEEEEEARHYRGVRRRPWGKFAAEIRDPAKKGSRIWLGTFESDVDAARAYDCAAFKLRGRKAVLNFPLEAGKYEAPANSGRKRKRSDVKEELQRTQSNSSSSSCDAF

SEQ ID NO: 5598 - protein, 587 aa, Gibberella zeae PH-1
MSAGDGTSTPGVGGSNASEFVRKLYRMLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNFLSPSTNRHQQTMHLNVGTSPLDGSDDSAPELRRARELLSSVTPDQIADRELERLQGVYGSPADSAVVIPQASMPMMHDPMNDINRYPVYPVGQTVGIDPFHSDHIHKIPYAMPNDSSANAMQEVAAPQPINIQTHGNSNSSANSALTWASRKPRIFLVEDDPTCAKIGIKFLKSMGCEVEHAQNGADAYSRITGVARDHFDMIFMDIIMPKLDGVSTTMYIRQDCPAIPIVAMTSNIRSDEVHCYFEHGMNGVLAKPFTKSGMQKIVENHLSYLLKGYDPSTQQESGSGYVVGGAGYMNPPSNLNTPGGTAFKFETTPTPPATGATWSPGQMPQQSPLTTGMDQGYGMVNGANQYGLTPTSASRASFPGNISQNNQGRMDGQSPPEKRQRTYV

SEQ ID NO: 5599 - protein, 349 aa, Solanum tuberosum
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDAMDGFSEGKFLSNSGVKSGDAKETSHVQPTKMKDANTHSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 5600 - protein, 744 aa, Vitis vinifera
  misc_feature (492)..(492): Xaa can be any naturally occurring amino acid
  misc_feature (607)..(607): Xaa can be any naturally occurring amino acid
  misc_feature (679)..(679): Xaa can be any naturally occurring amino acid
MEIDLNHAVTEVEKHAFCNGBCDKASCVCCLSSSSSSSSASNSSASPDSSSIYLELWHVCAGRLTSLPKKGNVVVYFPQGHLEQAASSSPFPPMDISTFDLPPQIFCRVVNVQLLANKENDEVYTQVTLLPQPELAGINLEGKELEGLGVDEEGGGGSPTKSTPHMFCKTLTASDTSTHGGFSVPRRAAEDCFPPLDYKQQRPSQELVAKDLHGVEWRFRHIYRGQPRRHLLTTGWSIFVSQKNLVSGDAVLFLRGEGGELRLGIRRAVRPRNGLPDSIIGNQNSYPNVLSLAANAVATKSMFHGLKVFNKQTHLNMLQDGNQVNKFFLKMLPEIHNLQNVEVFLSSGVVTGIGDLDPYRWPNSKWRCLMVRWDDDIVSDPQERVSPWEIDPSVSLPPLSIQSSPRLKKLRTSLQATPPNNPINGGGGFLDFEESVRSSKVLQGQENVGFVSPLYGCDKVNRSLDFEMQNPSLASTGIEKANFCEFMRAPPXTYTGFLESDRFPKVLQGQEIGPLRSLAGKSDFNLGSWGKPNLGCNLFNMYQKPKPNFYPLASEGIRNMYFPYNDIYKGGQDPVMLSYASNFPRENVPFNPSSIRSGVIGTEVRKXNIPNEPKPPENISAPPNLETNLKHQKDDTFSGTAAGCKLFGFSLTGETPPNSQNSGSQARQLSGTSHLISQXLEWLCEFCNVVSKIHIYTQEEVEKMTIGIISDDTQSCLEEAPVILDVSKSSSVGQPDSSPTVIRI

SEQ ID NO: 5601 - protein, 88 aa, Vitis vinifera
MDRRRRKLPKIAAPSQSEEVSSIEWEFINMSEQEEDLIYRMYRLVGDRWDLIAGRIPGRKPEEIERFWIMRNRQGYAERGKEASQKKQ

SEQ ID NO: 5602 - protein, 244 aa, Liquidambar styraciflua
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 5603 - protein, 605 aa, Solanum lycopersicum
MMMFEEMGFCGDLDFFPAPLKEVEVAAPQTEAEQVVDDDYSDEDIDVDELEKRVWRDKMKLKRLKEMNQGMEDVDSVKRRQSQEQARRKKMSRAQDGILKYMLKMMEVCKAQGFVYGIIPEKGKPVGGASDNLREWWKDKVRFDRNGPAAIAKYQAEHAIPGKNDVSNPVGPTPHTLQELQDTTLGSLLSALMQHCDPPQRRFPLEKGVSPPWWPTGQEDWWPQLGLQKDQGPPPYKKPHDLKKAWKVGVLTAVIKHISPDIAKIRKLVRQSKCLQDKMTAKESATWLAIINQEEALARELYPDRCPPLSSAGGSGTFTVNDSSEYDVDGAQDECNFDVQEQKPHHLNLLNVTVERFNERQPLQQQSHPIKDEIITSLDFTRKRKQSNEQTVTMAQIYTCEILQCPYSELRHGFQDRSARDNHQLVCPYRNTSQFGVSKFPMNEVKPVVLPQQYIPSTSVALPVNPSPPPFDLFGVGVPEDGQRMIDDLMSFYDCNIQGNKSQNTGNVAVTKEQQPHQQPRVDQVNYLHSRGMMEGNIFKDINVSASQSMQPQGNLVDQCKILNSSDNLQFMFGPPFNLQSTNYPGSLPGIGCDTTPKQDIPIWY

SEQ ID NO: 5604 - protein, 260 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQHHHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 5605 - protein, 162 aa, Triticum aestivum
  misc_feature (158)..(158): Xaa can be any naturally occurring amino acid
MSDCSTGTDSPRADSVDEQPPADAESPGGGQSKRDHPSPSSPLPPPKRSRRSVEKRVVSVPTSECGERAKTNGEGPPPPDSWAWRKYGQKPIKGSPYPRGYYRCSSSKGCPARKQVERSRADPTVLLVTYSYDHNHPWPAPKSGCQPNKSSPAAGGPXRAWH

SEQ ID NO: 5606 - protein, 422 aa, Medicago truncatula
MSETQKDHGIMLFGWKIPVPECRIPPNSGPMDTCSSTRKTEAEIPCAEKTEQQDNSSDSMDSKQESIQEKEPIVNSKPTEDNTETTDQDKLLKKPDKIVQCPRCNSWDTKFCYFNNYNVNQPRHFCKNCQRYWTAGGTMRNVPIGAGRRKNKHLASQYRQIIVTTNGIPTTRLESTNSSDHHHTSTDNETVLKFGPDTPLCESMESMLHLRDQKRNADANSNSSVQHREDPSLCGSSVTNTGNQGNEVSEHNASNWLQCYPVSPWVLPMNPGWNNVASMAAVHPTSASMQWCPTPMLAIPGIRPQNIPLQLVAASHWSGPSLCLSPPSSTSNSCCSGNGSPTLGKHSRDTVFVDEDKTDKCVPVRKTIRTDVTDAVSKSPIRATLATKKPNEEGKDGVLGGSQILEASSGAISHAHTIQESI

SEQ ID NO: 5607 - protein, 478 aa, Oryza sativa Indica Group
MDRDQMMNTMRDQAANLTSMNPLFYPFMADDALLGMAPPPPQQLLPSVSIQHMDWSPDTMLDNLTFIEEKIRQVKDVIRSMAGRRASSSSAATPEQQLVNADLTCLIVQLISTAGSLLPSLKNSSFLSRTTPPPAAAAGAAQAVSLAAGESSSSARNNETNREDEEEMGSPDYDELFKGWTNGGAMDEFVGAAGDEQDARENPAAAAAAAEEEEEKYEVLQLEEDEILAPHTHFCGICGKGFKRDANLRMHMRGHGDEYKSAAALAKPPPPPEGEEQPERRYSCPHAGCKRNRMHASFQPLKTILCVKNHYKRSHCEKRHVCGRCGAKRFSVMADLKTHEKHCGRDRWLCSCGTTFSRKDKLFAHVALFQGHAPALPPPPPPPPTTTTSTAASGRRRHKQEETEFTWGGGGGGDEFLDVKGIAGVGSGSGGGDEFFSAGSFGAMDFGFGQLDASLAMLLPSESEQFAGDHQEENGDDK

SEQ ID NO: 5608 - protein, 299 aa, Zea mays
MGEAASAVAASKRGGGGPAPFLTKTHQMVEERGTDEVISWAEQGRSFVVWKPVELARDLLPLHFKHCNFSSFVRQLNTYGFRKVVPDRWEFANDNFRRGEQGLLSGIRRRKSTALQMSKSGSGGSGGVNATFPPPLPPPPPASATTSGVHERSSSSASSPPRAPDLASENEQLKKDNHTLSVELAQARRHCEELLGFLSRFLDVRQLDLRLLMQEDVRAGASDDGAQRRAHAVASQLERGGGEEGKSVKLFGVLLKDAARKRGRCEEAAASERPIKMIRVGEPWVGVPSSGPGRCGGEN

SEQ ID NO: 5609 - protein, 215 aa, Vitis vinifera
  misc_feature (186)..(186): Xaa can be any naturally occurring amino acid
MKDTRTTGPTRRSTKGQWTAEEDELLCKAVQRFKGKNWKKIAECFKDRTDVQCLHRWQKVLNPELIKGPWSKEEDEIIIELVNKYGPKKWSTIAQALPGRIGKQCRERWHNHLNPAINKEAWTQEEELALIHAHQIYGNKWAELTKFLPGRTDNAIKNHWNSSVKKKLESYLASGLLAQFQSLSYXICPIILTRMGGQVHYIASLICRALQPLDL

SEQ ID NO: 5610 - protein, 363 aa, Arabidopsis thaliana
MTFFFLIQSFFPRTGFLLVRRHHHLYLSLNRSMKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 5611 - protein, 378 aa, Zea mays
CAVAAPCACCRQSLGLVKPLEEMLMAASAGAANPSQGSNPNPPPLAAPLTDAGSTERRARPQKEKALNCPRCNSTNTKFCYYNNYSLQQPRYFCKTCRRYWTEGGSLRSVPVGGGSRKNKRSSSSSSSSSSSAAAASASTSSSATSSSMASTPGAASKSPELAHEGAHDDLNLAFPHHGGLHAAEFAAFPSLESSNDMCDQGGGMTSNGRGGGAGPAVGALSATELLRSSGCYMPLQMPGGDYTAAGFALGEFRTPLLPPPSSQSPLGFSLDAHGPGSSGAAAAAGYGSSAGLPQGVPGNAGRLLFPFEDLKPPVSPGGGGVGGGGASATGGAGDGNSSHDQFDHNKERGGGGGRGAGAGHDTPGFWSSMIGGSGASW

SEQ ID NO: 5612 - protein, 229 aa, Chlamydomonas reinhardtii
MGWRRHRRKSAQVGDASHQHQRSARRRGCAPRLLGTAPTSSATTAPPPPHPQHAPSHGALQHNHHTHQPHTHPFHGSAPPSPVHFLAVYLGGYLTELDAAEAYDMAALVYWGEAATLNFPKEHYDCRRAELSTLDKDGVVALLRRRSTAAVGGRGASAYRGVTRHNLAERWEARIHLGANQYLLLGEFTEETAAAAAYDYAALRRRGVHRALTNFNPATYLDPDGTSRA

SEQ ID NO: 5613 - protein, 168 aa, Brassica napus
ESDEEDEDFVGGEDDDGGSPTDDSGGDDDDSDASDDGEGEKEKSITKEPKKETKSLPPKKKAVATEEGSSKKRKVKRKKDPNAPKKAMSGFMYFSQMERDNIKKTRPGLGFGDVAKVLGDKWRQMSAEEKEPYEAKAQVDKKRYEDQISDYKNPQPMLVDSENDSDSN

SEQ ID NO: 5614 - protein, 225 aa, Populus tomentosa
MAREKIKIKKIDNVTARQVTFSKRRRGLFKKAEELSVLCDAEVAVIIFSATGKLFEYSSSSMKGVLARYNLHSNNLDKINQPSLELQLENSNHMRLSKEVSEKSHQLRRMRGEDLQGLNIEELQQLEKALEVGLSRVLETKGERIMNEISTLERKGVQLLEENKQLKQKIATITRGKRPALVDLDTAVQEEGMSSESTTNVCSCSSGPPVEDDSSDTSLKLGLAI

SEQ ID NO: 5615 - protein, 350 aa, Nicotiana tabacum
MDPKFSGKPIPIPFLAGRTDLDQMPDTPTRIARHRRAQSETFFRFPDFDDDILLDDVVADFNLDISAPSLSPSADTHMQPANSADSSSTGGPGLMSGPGANNNPRPLNHFRSLSVDADFFDGLEFGATTPGAAAEEEKKVFGSSSVSGSGTRHRHSNSMDGSFSTASFEAECSSSVKKAMAPDRLAELALIDPKRAKRILANRQSAARSKERKIRYTSELERKVQTLQTEATTLSAQITVLQRDNSGLTNENKELKLRLQALEQGAHLRDALNEALREELQRLKIAAGQILGANGNRGPRPHFPPQPQSFVQCGSHHAQQQQQHMPHSTTSTQNIGGQTQPSFMNFNNRG

SEQ ID NO: 5616 - protein, 231 aa, Chlamydomonas reinhardtii
MSRSPRAIYEDYVGRRKGILRALTTDIDRFWSQCDPQKENLCLYAYQDGTWACDLPAEEVPPEAPEPALGINFARDGMERKDWISLVAVHSDSWLLALAFYKGARLNRDERDELFGLINKLPTCYEVVSGRVKQTNGGPTTNAGGMKRPGGPGGPSRASARARADEGGASGDWEDGEGDPCPACGRLYRTDEFWIACDACDTWYCGRCAKMTEKKAAQMKHWRCGQCAGPQ

SEQ ID NO: 5617 - protein, 316 aa, Myxococcus xanthus DK 1622
MPEGSASLQLAVGDRVVYPNQGVCRVSAIDVKEVAGQKLTFVTMRREEDGAVVMVPEGKVLAIGVRKVASAEDVEAIFTFLRSDSDKADLDWKQRARTNLDRMTQGGIMGLAEVVKGLQVLSELRPLPTKERELYDNARHLLVTEVAAALGTAEVNAEDAIDIVLFPPGRERPKRTAAEFQREEGDLDLDSDLLGLDSDLDLPSDEEPSEPSEEESSEEGESEEAASSEESAPKKRGRPPKAKTEAPEGAEPPAPKKRGRPPKPKPEATAEGAEPPAPKKRGRPPKPKPPEVEGAAPAAPKKRGRPPKVKPPEGES

SEQ ID NO: 5618 - protein, 352 aa, Glycine max
MDGREAMAFPGSSAPYYMHRVGIGGSASGFEPAPGFRPLSNTGIQAESNARGGQGQGGGSVGSSSPFSVEPPQGHTNFNHGIGIGAPSSEPVKKKRGRPRKYGPDGAVSLRLSPMSAPANSTQDASETTPSQKKARGRPPGSGRKQQLAALGEWMNSSAGLAFSPHVITIGVGEDIVAKLLSLSQQRPRALCIMSGTGTVSSVTLRQPASTNASVTFEGRFQILCLSGSYLVAEDGGPLNRTGGISVSLSSPDGHVIGGGVAVLIAGSPVQVMLCSFVYGGSKTMSKQATTLKDESSEPPPQHNDKLASPASAPAPPGQNFLPLSAANLWPGSRPAELKSAHMHTGIDLTHG

SEQ ID NO: 5619 - protein, 1194 aa, Arabidopsis thaliana
  misc_feature (152)..(152): Xaa can be any naturally occurring amino acid
  misc_feature (196)..(196): Xaa can be any naturally occurring amino acid
  misc_feature (561)..(561): Xaa can be any naturally occurring amino acid
  misc_feature (594)..(594): Xaa can be any naturally occurring amino acid
MRGYIRSTSVVILIDFGATSCFIHEGIVKHKGWRVTETRGFGVKVGGGRVIRGSGKCADIALEVQGIEFIEDFLLFDLGDLDVVLGFSWLARLGDTRAKWGQLRLSWQIGNTWVTLHGDPELCREQVSLRAMERVIKYTGAAYLLELSTLFXSYEPQDKKAIVQDIKRVLDNYGSVFQMPKGLPPSRNREHAITLXMKNEIEKLVREMLDSQIIRPRHMPHPRPTWIRPCSSPILLVKKRDGGWRFCVDYRALNKATIPDRYLIPVIEELLDELKGVAMFSKLDLKSGYFQIRMKAEDVEKTTFKTHQGHYEFLAATSSFQALKKAVTQLPVLILPDFQKQFTVETDASGTGIGVVLSQEKRPIAFLSQGFSSQGRIKSVYERELLAIVMVVTKWKHYLAGKEFVIKRDQRSLKHLLDQNAVSTIQQRWASKLIGLKYKIEYKPGVDNKVADALSRKPQTEVFSQLTLQATHTIDITALKEAVKADKELSKLLQDIEQGCQKNGDFTVEDGVPYRKGCLVVPVVTPFIPKLLETFHTSVVGGHEGALKTFKRLTKENKYSXTLSPAGLLAPLPIPQQTWEDISLDFVEGLPVSXRVLVVVDMLSKYGHFIALKHPFTAKTVVEAFIRDVIKLHEFPSMMVSDRDKIFLSHFWTELFKLQGTALHKSFAYHPQTDGQTEVDNRCLESYLRCFTGRRPTTWIQWLPWAEYWYNTSYHSATKTTPFMAVYGREPPAMIRYGDVPTPNANVEELLRDRDGILMELRENLVLAQNRMCKDANKHRRDVVFEVDEWVYLKLRPYRQNSVVHRKNEKLAPRYFGPYQIISKVGNVAYKLKLPAHSHIDPVFHVPQLKLAVHAAYSPQELPKIMTPLLEWAVGPEKLLDIRKAESGNSAEVLVQWSGLSELEPLITLVQQFPKFDLEDKINLLRESIDRLRVALGKMRRKMRSGGRKARALEKYLRKAYQDPDLYRNCDDISELKIIEDRLMRTRKHLMDCLEKKEKSQFVSDQKPSTDEIFNHGGFSSPFSQIASDFGQNPSTSTLSSSQIASNFGQNPSTYSPNSSQIVCFYQNHGEPRSSQVTCFDQNHIFFVDESLFDQSGYLVNDDQSGYLVNVNLGFVDSLCEIEEEKNGMSVPQETQTSTLFTEDQSFWENLFKDFNNENLEVPLQDHSSTNEKDEFMIDISEYLSEEAMEWPLV

SEQ ID NO: 5620 - protein, 168 aa, Helianthus annuus
SSGDASQRLAHVFASGIEARLAGTGSQLYAAKCAIRISAAEKLQAYQVYLSACPFKKIGMSFANKTIFDSALASSNPTIHIVDFGIAYGFQWPIFIQHLSEVHDGPRKLRITGIEYPQPGFRPAERLQETGRRLANYCERFNVQFEYNSIASQNWETVKIEDLKLQRN

SEQ ID NO: 5621 - protein, 661 aa, Neurospora crassa
MPPPEGDSASVQAGNNSSDFVRKLYKMLEDPTYNSVVRWSADGDSFVVLENEKFTKTILPKHFKHSNFASFVRQLNKYDFHKVRHNEESGEAPYGRDAWEFRHPEFRADRKDNLDNIRRKAPAPRKPAQAEDTFGASQQIVVLSESLTATQHQIQALQEQYFELAQTNKVLVNEVISLQKMVRAQSQVSNELITHLSNIEDRRRNSRHSAHSSHSSHSGPTFHAGSLGLLPDGADEPAAELRRAREILNGVSPDSQADRELERLSVAYHQNGSPSESATSSVMFTQSGPGPMHMLHDPLNDPRHMVYPVGQTTGIDPFHSDHINNIPYTRPLSNPNAMADSAQITPPPKDQGTSMWSHKRPRILLVEDDKTCARIGAKFLHVLECSVDIAKDGLEAVEKINNPENNEGFDLIFMDIIMPNLDGVSATAMIRMVTARVPIIAMTSNIRQEDIQTYFQYGMNDVLAKPFTKDSMIRVLRKHLAYMLKDPLQGGLNADDTGQTVGAPGPPGQNQQAYSNNQQAQANMMAAAAAMANSSMGSSAQVKFEQTPIPSPATTSSWHSPGQMNQTSPNMDGGGYMNAGGNGPGGMVLTPGGTQRPPPPPYQMMNNQVNNQLAGGSAGFQGGGHIQASEGMGMGGSEENRPEKRQRLYGPGANHQRPFVQ

SEQ ID NO: 5622 - protein, 644 aa, Vitis vinifera
MSEGHLFNNISLGGRGGTNPGQLRVHPGGILWKKQGGGKAVEVDKSDIVGVTWMKVPRTNQLGVRVKDGLYYKFTGFREQDVTNLTNFFQHSCGLNPEEKQLSVSGRNWGEVDLNGNMLTFLVGSKQAFEVSLADVSQTQMQGKNDVILEFHVDDTTGANEKDSLMEISFHIPNSNTQFVGDENRPPAQVFRDKIMSMADVGAGGEEAVVTFEGIAILTPRGRYSVELHLSFLRLQGQANDFKIQYSSVVRLFLLPKSNQPHTFVVVTLDPPIRKGQTLYPHIVMQFETDYVVQSELSLSEELLNSKYKDKLEPSYKGLIHEVFTLILRGLSGAKVTKPGKFRSCQDGYAVKSSLKAEDGVLYPLEKSFFFLPKPPTLILHEEIDYVEFERHAAGGSNMHYFDLLIRLKTEQEHLFRNIQRNEYHNLFDFISGKGLKIMNLGDVQTADGVAAVLQNDDDDAVDPHLERIKNEAGGDESDEEDEDFVLDKDDGGSPTDDSGEEESDASESGGEKEKPSKKESKKEPSVSKASSSKKKPKDGDEDGSKKRKQKKKKDPNAPKRAMSGFMFFSQTERENIKKSTPGIAFTEVGRVLGDKWKKMTAEEKEPYEAKAQADKKRYRDEISGYKSNPQPMNVDSGNESDSE

SEQ ID NO: 5623 - protein, 579 aa, Arabidopsis thaliana
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEVGESQTFSVLSLETLKYLTLVFLPFFRGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCVDSASYPWIIWYIWKARNEKVFENVDKDPMEILLLSVKEAQSWQEAQVELHSEKHGSLSIDSRIRVRDVSQDTTFSGFRCFIDGSWKASDQFSGTGWFCLSSLGESPTMGAANVRRSLSPLHTEMEALLWAMKCMIGADNQNVAFFTDCSDLVKMVSSPTEWPAFSVYLEELQSDREEFTNFSLSLISRSANVKADKLARKIRTVPHHVTYVNNIPRDWLF

SEQ ID NO: 5624 - protein, 732 aa, Oryza sativa Japonica Group
MLLLILVRSSFAEFSESEVCADESDKNKPSKSSNAVRLFACTSTLTQATHKITSSVSEGTVGPPEGSNDLPQPGQFDSGSPDHNTTPCHGVRSDLKQGKCRKLQAFQTAKTNTSEKRKCLFSTEVQLMDGCQPEKLNDEILGCDWDDLISATSGELIAYDEDHKGVQLAVSNAESCGFLLSKLTGDGDISDRTHPSSSTQTYYRELLMDEDQTENAQLVPDGEKNISTEEIQDNLYEANGSIPTGYKVETQQQRGMRRRCLVFEAAGYSNRIVQKESVMDLSVSTCKGKSPVQNHSNPGKTPSPRVLRGIGLHLNALALTSKDKMICQDPMSSLVPSSATQQEAHGKMLSAGENFIHPGGELLELQMDDDCSAGVFLGNDHDSSQSNSPQKKRRKSDNGDDGEACKRCSCKKSKCLKLYCECFAAGVYCSEPCSCQGCLNKPIHEEIVLSTRKQIEFRNPLAFAPKVIRMSDAGQDITGEDPNNTPASARHKRGCNCKKSSCLKKYCECYQGGVGCSSNCRCEGCKNTFGKRDAAVSTEAEEMKQGGEEAENCGKEKENDLQKANAQSEDHPFLELVPITPPFDVSSSLLKPPNFSSAKPPRPTKARSNSSRSSSKAPGAVHSQKFSKIANSGLNEEMPDILRDDASPGNCVKTSSPNGKRVSPPHNALSVSPSRKGGRKLILKSIPSFPSLIGDASSGSSMNSSESAFNTASPLALASYSYACPWNQPGPS

SEQ ID NO: 5625 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADTENVIAEDGQSSESVMTALHSGSSQDNDDGSDVSLKLGLPCVAWK

SEQ ID NO: 5626 - protein, 306 aa, Musa acuminata
MSGESSEPYSHDFPFHDDLFSVFSQKPDGLQGFDPQTAPPFMSFGDYLHGSTTDGSLVVQGFDAPRSQPCDPVVGGDGGKNAAAGGGDGMTPVTPNFSASSSSTEAAGDEDWRPCKVDQPKQEVQEEEKHAPQDGEGRDKTKKANKPRKKGERQRGPRFAFMTKSEVDHLEDGYRWRKYGQKAVKNSPYPRSYYRCTAQKCNVKKRVERSCQDPTTVITTYEGQHTHHSPASLRGGGGGHMLSPSPTTNLRRSLLLQQVSRSSSSAGYTNPNTYHAGLPPLLPQLHVPDHGLLQDIVPSFTHGSQR

SEQ ID NO: 5627 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 5628 - protein, 961 aa, Arabidopsis thaliana
MEAESSTPQERIPKLRHGRTSGPARRSTRGQWTAEEDEILRKAVHSFKGKNWKKIAEYFKDRTDVQCLHRWQKVLNPELVKGPWTKEEDEMIVQLIEKYGPKKWSTIARFLPGRIGKQCRERWHNHLNPAINKEAWTQEEELLLIRAHQIYGNRWAELTKFLPGRSDNGIKNHWHSSVKKKLDSYMSSGLLDQYQAMPLAPYERSSTLQSTFMQSNIDGNGCLNGQAENEIDSRQNSSMVGCSLSARDFQNGTINIGHDFHPCGNSQENEQTAYHSEQFYYPELEDISVSISEVSYDMEDCSQFPDHNVSTSPSQDYQFDFQELSDISLEMRHNMSEIPMPYTKESKESTLGAPNSTLNIDVATYTNSANVLTPETECCRVLFPDQESEGHSVSRSLTQEPNEFNQVDRRDPILYSSASDRQISEATKSPTQSSSSRFTATAASGKGTLRPAPLIISPDKYSKKSSGLICHPFEVEPKCTTNGNGSFICIGDPSSSTCVDEGTNNSSEEDQSYHVNDPKKLVPVNDFASLAEDRPHSLPKHEPNMTNEQHHEDMGASSSLGFPSFDLPVFNCDLLQSKNDPLHDYSPLGIRKLLMSTMTCMSPLRLWESPTGKKTLVGAQSILRKRTRDLLTPLSEKRSDKKLEIDIAASLAKDFSRLDVMFDETENRQSNFGNSTGVIHGDRENHFHILNGDGEEWSGKPSSLFSHRMPEETMHIRKSLEKVDQICMEANVREKDDSEQDVENVEFFSGILSEHNTGKPVLSTPGQSVTKAEKAQVSTPRNQLQRTLMATSNKEHHSPSSVCLVINSPSRARNKEGHLVDNGTSNENFSIFCGTPFRRGLESPSAWKSPFYINSLLPSPRFDTDLTIEDMGYIFSPGERSYESIGVMTQINEHTSAFAAFADAMEVSISPTNDDARQKKELDKENNDPLLAERRVLDFNDCESPIKATEEVSSYLLKGCR

SEQ ID NO: 5629 - protein, 258 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 5630 - protein, 210 aa, Solanum lycopersicum
MAMVNLNGISKEVHYRGVRKRPWGRYAAEIRDPGKKSRVWLGTFDTAEEAARAYDNAAREFRGAKAKTNFPKLEMEKEEDLKFAVKNEINRSPSQTSTVESSSPVMVDSSSPLDLSLCGSIGGFNHHTVKFPSSGGGFTGSVQAVNHMYYIEALARAGVIKLETNRKKTVDYLGGGDSDSSTVIDFMRVDVKSTTAGLNLDLNFPPPENM

SEQ ID NO: 5631 - protein, 446 aa, Brassica napus
  misc_feature (216)..(216): Xaa can be any naturally occurring amino acid
MMFNEMCMCGNMDFFGELDFCPPPPQPEPVTEEDYTDEEIDVDELERRMWRDKMRLKRLKEQKDKSREGAVDAAKQRQSSQEQARRKKMSRAQDGILKYMLKMMEVCKAQGFVYGIIPENGKPVTGASDNLREWWKDNVRFDRNGPAAISKYQAENNIPGVRERSNHIGPTPYTWHELQDTTLRSLLSALMQHCDPPQRRFPLEKGVPPPWWPNGXEDWWPQLGLPKDQGPAPYKKPHDLKKAWKVGVLTAVIKHMFPDIAKIRKLVRQSKCLQDKMTAKESATWLAIINQEESLARELYPESCPPVSLSGGGSCSLLMNDCSQYDVDGLEKETRYEVEELKPEKVNFGMAANFPVKEEVPSEFMRKRKPNRDLNAMMDRTIFTCENTGCAHGDVSRGFLDRNSKDNHQFVCPHRDSGLPYGAPSRFHVSEVKAGWVGFSQPRPVK

SEQ ID NO: 5632 - protein, 141 aa, Triticum aestivum
MFSSTSSYSEEPECIAESNSQPKKKKKAKRPTPPVTSDAEGDADYEEGSGTALAPGEVRRCTHCQIDKTPQWRAGPLGPKTLCNACGVRYKSGRLFPEYRPAASPTFVPAIHSNSHKKVVEMRQKVEPKGDDLLQFIRRRD

SEQ ID NO: 5633 - protein, 256 aa, Zea mays
MGRSPCCEKMGLKRGPWTAEEDRILVVHVERHGHSNWRALPKQAGLLRCGKSCRLRWINYLRPDIKRGNFSREEEDAIIQLHQMLGNRWSTIAARLPGRTDNEIKNVWHTHLKKRLEAQPASQQAPKRKPTKKQQPEPVTTLEGPAGAVPPVSPERSLSTTTSTTTSTADYSAASSLENADDSFTSEEDYYQIDDSFWSETLAMTTTVDSFESGVQQAEGSFGASAAAPSSTNDDMDFWLKLFMQASDMQNLPQII

SEQ ID NO: 5634 - protein, 390 aa, Gossypium hirsutum
MCGGAIISDFIPPSRSRRLTADFLWPDLKKSGLKKGSGKRYSKPVIDLGDDFETDFQEFKDEESDIDDYDVDDVLADVKPFAFNATKKPASAVSHGSNSEKSMQFNGQAEKCAKRKRKNQYRGIRQRPWGKWAAEIRDPRKGVRVWLGTFNTAEEAARAYDAEARRIRGKKAKVNFPNETPRTSPKHAVKTNSQKPLSKSNSSPVQPNLNQNYNYLNQPEQEYFDTMGFVEEKPSVNQFAYVDPVPTSIDAGFNQSDNAPLYFNSDQGSNSINCSDYGWGEQGAKTPEISSILEASVEGDEFLEDANPSKKLKPSSDNVMPAEDNSAKTLSDELLALDNQMKYFQMPPFIEGNWDATIDAFLNGDATQDGGNPMDLWNFDDFPTMAEGVF

SEQ ID NO: 5635 - protein, 232 aa, Populus trichocarpa
MATTSQATLNQQPLFEDQEMPTQMGFFSFPPHLTYPQSASCHQSLKGFIIPPSLAADAPSTTNLTETLLLSSVTNKQREDTIASDLGGPHLLSLQRSSANLWAWGEVNECLNSKRSGSGGDHLGVSTIKLKKIKARRKVREPRFCFKTLSDVDVLDDGYKWRKYGQKVVKNTQHPRSYYRCTQDNCRVKKRVERLAEDPRMVITTYEGRHAHSPSHDLEESQTPSQFNNFFF

SEQ ID NO: 5636 - protein, 810 aa, Medicago truncatula
MEIDLNDSITEVKKNVCSNGKCEKSVCCVCTLSSSSSPTCSSSSSTSAIVSSSYLELWHACAGPLTSLPKKGNVVVYFPQGHLEQVASLSLFSSLEIPTYGLQPQILCRVVNVQLLANKENDEVYTQVALLPQAELAGMCLDDKEPEGLEADDEGNGRSPTKLASHMFCKTLTASDTSTHGGFSVPRRAAEDCFPPLDYKQQRPSQELVAKDLHGVGWKFRHIYRGQPRRHLLTTGWSIFVSQKNLVSGDAVLFLRGENGELRLGIRRAARPRNGLPESIIGNQSCSPSFLSSVANAISAKSMFHVFYSPRASHADFVVPYQKYAKSIRNPVTIGTRFKMKFEMDESPERRCSSGIVTGMSDLDPYKWPKSKWRCLMVRWDEDIGANHQDRVSPWEIDPSTSLPPLNIQSSRRLKKLRTGLHVESPSHFITAGDSGFMDFDESIRSSKVLQGQEKTSFMSLYYGCDTVTKQKEFDINSLRHTNLASNGARKITSSEFTRIQPSSYADFTEMNRFPRVLQAQEIYPLRSLTGKVDLNLNSWGKTNVSYTKYNLHNATKLNFHSLGSEVLQNSSFPYGDIHKVGQGSSMLCSKPTNFQLGNVSFNTPSSQIGALRNEVGLSSFKIRNEQKLQNDISAATSLDANIRISNDENFKEMVNPCKLFGFSLSAAAETTSQNLQNSAKRSCTKVHKQGSLVGRAIDLSRLSSYNDLVSELERLFGMEGLLRDPDKGWRILYTDSENDIMVVGDDPWHEFCDMVSKIHIYTQEEVEKMTIGMMNDDNQSCLEQTPLIMEASKSSSVGQPDSSTTVVRI

SEQ ID NO: 5637 - protein, 255 aa, Prunus persica
MGRGSVQLKRIENKINRQVTFSKRRSGLLKKAQEISVLCDAEVALIVFSTKGKLFEYSTDSCMERILERYERYSYSEKQLLANDHESTGSWTLEHAKLKARVEVLQRNCSHFMGEDLQSLSLKELQNLEQQLDSALKHIRSRKNQVMYESISELQKKDKALQEQNNLLAKKVKEKEKALAPQAESWEQQVQNQGLDCSSTLLPEALQSLNFGSGSNYQGIRNDGSGGDHEDENETPTANRPNTLLPPWMLRHLNE

SEQ ID NO: 5638 - protein, 378 aa, Oryza sativa Indica Group
MDTFSHVPPGFRFHPTDEELVDYYLRKKVASKKIDLDVIKDVDLYKIEPWDLQEKCKIGMEEQNDWYFFSHKDKKYPTGTRTNRATGAGFWKATGRDKPIYARSCLVGMRKTLVFYKGRAPQWPEVGLDHARVPPRDQRKRHHTCMHIFDEEGWVVCRVFKKRVATVRRMADGSPCWFDDHGAVGAFMPDLSSPRQLLPHHHHHHPGSSAALYHGHHHQQLQQMYGHCKPELEYHHLLPQEAFLQHLPQLESPKPPPPPPAAAAYIGGHLGSSSSTALTTHDDEASGSAAQQQPPSLEAVYMAGAGVGVGIGVDASVTDWRLLDKFVASQLLSKESMSSYGSHPAQVFQAADGGKHEEALDYASTSAGSGGGEADLWK

SEQ ID NO: 5639 - protein, 227 aa, Vitis vinifera
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 5640 - protein, 266 aa, Xanthomonas axonopodis pv. citri str. 306
MRCTHLASALRMPASANPRRRAARGGKCAAQSAATLPGRARPSPRPPSACRAQMCHPAREITMVHAPPRVVVTTAILAALNLAGCANFCGAAHHAPVPYAHREPPPPPPPPPPDARNIDALPACAPEHDVVPTPPADLAHRAAPERQDRESVDGCLVDRGVPPPPPFDGDAFDAPDAADGPPGLPPDDSEFDAALQACATAEGIAAPFPQAPSPDLPPDLLAECLDAAGFAPPPPPPPPPPPPPPPPPPPPPPPPPPPPPPFQPPR

SEQ ID NO: 5641 - protein, 408 aa, Zea mays
KVEIDSAQTQHQNSVLQGQEQMTLRNNLTESADSDSTVQKPMMWSPSLNGKAHTHFQQRPAMDNWMPLGRRENDFKDTRSAFKDARTASQSFGDTQGFFVQTYDDNHHRLSFKNQGSTHRFADPYFYMPQQSSVTVESSTRTQTANNDLCFWSDQNAMYGNPSDQKQGFNFGQNPSSWLNQPFPQVEQPRVVRPHATVAPFDLEKTREGSGVRIFGFQVDTTSPSPVQLSSPLPAIQEHVLQTRPSAPVNELQPVQIECLPEGSVSTAGTATENIQQAPQSSKDIQSKSQGASTRSCTKVHKQGVALGRSVDLSKFTDYGELQAELDKMFDFEGELVSGSQNWQIVYTDDEGDMMLVGDDPWEEFCSIVRKIYIYTKEEVQKMNSKSAAPRKEESPAAGGGGCAATNE

SEQ ID NO: 5642 - protein, 280 aa, Petunia x hybrida
MGRAPCCEKMGLKKGPWTPEEDQILVSYIEKNGHGNWRALPKLAGLLRCGKSCRLRWTNYLRPDIKRGNFTREEEDTIIQLHEMLGNRWSAIAARLPGRTDNEIKNVWHTHLKKRLKNYQPPQNSKRHSKNNHDSKAPSTSKMLDNSESFSTIQENINEPMTGPNSPQRSSSESSTVTADSLAATDVTNDDQTFIKHEEMDSYENFPEIDESFWTEDLSMGDNLDLDMEVAGEKSQVQFPYSHDMKEQSVDMVGAKLEDDMDFWYNVFIKAEDLLDLPEF

SEQ ID NO: 5643 - protein, 354 aa, Arabidopsis thaliana
MDMDEMSNVAKTTTETSGLTDSVLSLTKRMKPTEVTTTTKPALSNTTKFKGVVQQQNGHWGAQIYADHRRIWLGTFKSAHEAAAAYDSASIKLRSFDANSHRNFPWSDFTLHEPDFQECYTTEAVLNMIRDGSYQHKFRDFLRIRSQIVANINIVGSKQVLGGGEGGQESNKCFSCTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYTCDVPNNVKTLEGQSKTFLMIDVHHFSGNGFVVPEEVNKTVHEISDEEMKTETLFTSKVEEETKSEEKKGGFMLFGVRIQ

SEQ ID NO: 5644 - protein, 641 aa, Oryza sativa Indica Group
MTDGHLFNNILLGGRAGSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSEKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 5645 - protein, 359 aa, Glycine max
  misc_feature (344)..(344): Xaa can be any naturally occurring amino acid
MTRRCSHCSNNGHNSRTCPSRGGGGVKLFGVRLTDGSIIKKSASMGNLNLSSAAAHHQFHSSPSSSNLAAAPSSPNPSSPCSDPPQGYLSDDPAHVSTFANRRGDRKKGVPWTEEEHRLFLIGLQKLGKGDWRGIARNFVVSRTPTQVASHAQKYFIRQSHATRRKRRSSLFDMVPDMSSDQPSVPEEQVLLPPSQNSQPCNGKSQPSLNLSLKSEFEPMETTSQENAQQTNETMMGSIGLTPMAPHGFFPAYLPVPFPMWPSTVAPPFEEVKGGETSHHQIHKPIPVIPKEPVNVDELVGMSHLSIGEAKVRDREPSPLSLKLLGEPSRQSAFHANAPVGTSXFKQWQGQRNSSCLSL

SEQ ID NO: 5646 - protein, 110 aa, Viola pubescens
VYLGGFDTAHAAARAYDRAAIKFRGVEADINFSIEDYEDDLKQMTNLTKEEFVHVLRRQSTGFPRGSSKYRGVTLHKRGRWEARMGQFLGKKYVYLGLFDTEVEAARAYD

SEQ ID NO: 5647 - protein, 61 aa, Physcomitrella patens subsp. patens
HYRGVRQRPWGKFAAEIRDSARQGARVWLGTFDTAEQAAMAYDAAAFKMRGCRALLNFPLQ

SEQ ID NO: 5648 - protein, 83 aa, Physcomitrella patens subsp. patens
KSKRKGLKRMREPRYSIQTRSILDIMEDGYKWRKYGQKAVKNSPHPRSYYRCTNPKCPVRKKVERSADDSELVITSYEGTHTH

SEQ ID NO: 5649 - protein, 158 aa, Brassica napus
LDKAALLATVIEQVNELKQTATQSPTFQDLPTEADEVTVQPETISNDFESDTIIFKASFCCEDQPEAIPEIIRVLTKFQLETLHAEIICVGGRMRINFILRDSNCKETTTNSVSSAKALKQSLCAALNRISSSSSSSTSSVCRIRSKRQRWFLSSHYS

SEQ ID NO: 5650 - protein, 431 aa, Oryza sativa Indica Group
MVKCPYPALCFCLRWLVLQRRFHHRHGATLIFLTTPGEGSYSSLLSTMMMSSSVDHFSNNSNNNQAMYLEQDEDFSQMIMELCDFDASSTTQARHGGEAAAGDARAVLTYLTFLEQKIGHLRGIISSTPNPPPQIVAAELSCIVVQLVSISKNLAAARRGGDDADADAKHDGSSDADEGGDGDGDGERAPPRGPYEVVQIEKEEILAPHVHFCGVCGKGFKRDANLRMHMRGHGDEYKSSAALAKPDAGGAPPSPSRSPARRRFYSCPYVGCKRNREHKSFQPLKTPICVKNHYRRSHCDKSFTCRRCNVKKFSVVADLRTHEKHCGRDRWVCSCGTSFSRKDKLFAHVAIFDGHSPALPPEDYDDDAASGQLPHAAGEAVGRTVDTNRFFSDGLMIKGSMDDERGTLSPMGLDYCEFDGIDLFAAAAFDF

SEQ ID NO: 5651 - protein, 356 aa, Medicago truncatula
MTSQKFNNGDMSLFPLAPIPSTHPFDSKALPLTNLEKGLQILRPSMFKSKVEDGCFEVQGKNLSLKLGNEVEDKSSVSVKVGYSKLCSRGHWRPIEDAKLKELVAEYGPQNWNLIAEHLEGRSGKSCRLRWFNQLDPRINKKTFSEEEEERLLSAHKMYGNKWAIIARLFPGRTDNAVKNHWHVIMARRHREQCTVYRRRKPVVVESLSKDLKLSLSNNAASDSTISSTIDGNVSTCTNLLLTPSSAKLVVPVENHQGYGSLMDKSRESVVATRDVNFDKYFGACKKNEQVEKLKLIDVVVDQSNFSDSNSEVSVSESVTTNRSNISISGESENVGVKINMLLPFIDFLGVGAIQS

SEQ ID NO: 5652 - protein, 252 aa, Brassica juncea
MAYQTELGGESSSQRKAGRGKIEIKRIENTTNRQVTFCKRRNGLLKKAYELSVLCYAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 5653 - protein, 422 aa, Oryza sativa
  misc_feature (190)..(190): Xaa can be any naturally occurring amino acid
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPVFDPMLAELYNPVAADDEEQQIEQKPAARVVXPFSEPSPEFASGSVEADGLSGFDVPDMELASFAADMESLLMGVDEGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 5654 - protein, 987 aa, Arabidopsis thaliana
  misc_feature (966)..(966): Xaa can be any naturally occurring amino acid
MEAESSTPQERIPKLRHGRTSGPARRSTRGQWTAEEDEILRKAVHSFKGKNWKKIAEYFKDRTDVQCLHRWQKVLNPELVKGPWTKEEDEMIVQLIEKYGPKKWSTIARFLPGRIGKQCRERWHNHLNPAINKEAWTQEEELLLIRAHQIYGNRWAELTKFLPGRSDNGIKNHWHSSVKKKLDSYMSSGLLDQYQAMPLAPYERSSTLQSTFMQSNIDGNGCLNGQAENEIDSRQNSSMVGCSLSARDFQNGTINIGHDFHPCGNSQENEQTAYHSEQFYYPELEDISVSISEVSYDMEDCSQFPDHNVSTSPSQDYQFDFQELSDISLEMRHNMSEIPMPYTKESKESTLGAPNSTLNIDVATYTNSANVLTPETECCRVLFPDQESEGHSVSRSLTQEPNEFNQVDRRDPILYSSASDRQISEATKSPTQSSSSRFTATAASGKGTLRPAPLIISPDKYSKKSSGLICHPFEVEPKCTTNGNGSFICIGDPSSSTCVDEGTNNSSEEDQSYHVNDPKKLVPVNDFASLAEDRPHSLPKHEPNMTNEQHHEDMGASSSLGFPSFDLPVFNCDLLQSKNDPLHDYSPLGIRKLLMSTMTCMSPLRLWESPTGKKTLVGAQSILRKRTRDLLTPLSEKRSDKKLEIDIAASLAKDFSRLDVMFDETENRQSNFGNSTGVIHGDRENHFHILNGDGEEWSGKPSSLFSHRMPEETMHIRKSLEKVDQICMEANVREKDDSEQDVENVEFFSGILSEHNTGKPVLSTPGQSVTKAEKAQVSTPRNQLQRTLMATSNKEHHSPSSVCLVINSPSRARNKEGHLVDNGTSNENFSMYIYTTLTKIFLVLFLLSFLATMILFLLSIYRFCGTPFRRGLESPSAWKSPFYINSLLPSPRFDTDLTIEDMGYIFSPGERSYESIGVMTQINEHTSAFAAFADAMEVSISPTNDDARQKKELDKENNDPLLAERXCWTSTIASLQSKQQKKSHPTS

SEQ ID NO: 5655 - protein, 223 aa, Zea mays
MAPRNALPAASAVANGMVMEPRFRGVRKRPWGRFAAEIRDPARKARVWLGTFDTAEAAARAYDAAALHFRGPKAKTNFPVAFAALPPPPPPKKPAAVTVSPSSSSTVESSSSSSSRDSPATPPRAASPSQQAPSLDLSLGGTPAMVAAQPFLFLDPRLAVTVAVPAPVPYRPTAVAAGANKRDAASCREEEQSDTGSSSSVVDASPAVGVGFDLNMPPPAEVA

SEQ ID NO: 5656 - protein, 507 aa, Oryza sativa Japonica Group
MASSSSDLTLDDHHHLTAVAAASGQATQKLQEFLSRLEEERLKIDAFKRELPLCMQLLNHAMEAYRQQLEAYQMGSQHSAAAAAAARAPLVLEEFIPVKNIGIDVVAADKAAAAGGNSVSSEKASWMVSAQLWNAPASASAADTAAKGPQTPKEHSEHHPLDTSPKLITALDGCVSLSARSCPSPRTTPWVTDQPPLAAALPELALAPAEKAADAITIAAGEVDKKPYAHDNGVVARSREAQNGGKPPSTPSDGQAVPPPPQPHRKARRCWSPELHRRFVNALQILGGAQVATPKQIRELMKVDGLTNDEVKSHLQKYRLHTRRPMPSPAPPTAATPQLVVLGGIWVPPEYATQAAGPAIYGAHPATQPHYTAAVAAQEYYHHHHHHLQHHPAAAALVHHRAVAPPPPLPPQQQLAPPYSAKSSASARLGSPDSDGRGSGGGGGAAASGAGRDMSESIEEEGEGEEREDDDDDDEMAATNNAHAVDGDDDNDEINTTTTTSAGAINY

SEQ ID NO: 5657 - protein, 253 aa, Zea mays
MDASLAGVVLRRGHMISIGHRKIRSIHYLHRPHPPVRGYSSHHYKERIVTHREFVMDQDDYLSLCLAAALVAASQQAAGDAPPLRARAAASELRPLHFRCPICGKAFASYQALGGHKASHRKPAAAAAAYDGKAPSSPSSSGQHQKGAVAAGIGGASAGGRHVCTVCHRYFATGQALGGHKRFHYLHGPSVPASSLPPSTAGAAAGVGWLDLNLTPLAPDVSFAGVRRRRGEDDEVQSPLPLPAKKHRASTSA

SEQ ID NO: 5658 - protein, 211 aa, Brassica napus
DLEKRSCRRRLACHNERRRKPQATTAALLASGYSRIAPSLYGSVLGDPTTWSTARSVMGRSAPWDSHQLMNVLSQGSSRFSITYPEMVNNNSTDSSCALSLLSNSNTTQQQQQTSTNAYLMDAERVTMAKSPPVSVHNQYSKQTWEFMSGEKSNWPCVSSPVLGLRQISEPDDDLQFLMSNGTTMGGFELNLQQEQVLRQYSSTQNFTWPL

SEQ ID NO: 5659 - protein, 2014 aa, Synechococcus sp. WH 8102
MKSDSDTEGTELWKDSTTGSLFIVDDGKEKSDRKQILDQGGWEPQLEFSDNWEGGSHTSTVFAVEATNNGYALVIKHEDTFNDHDTISGGEGYDTISGGEGYDTISGGEGYDTISGGEGYDTISGGEGYDTISSGEAEDTIFGGESNSVPPPSEAPTPFVQAKPDEDDSNSMVFWEILNLDSEARIDWSQISAFTESIAGYEKVFNQDLDLDGKIGVDIGALSSLQTDTTGYQLKVSTAGTVHIWDGTNSESIVDVTDINGGTPSMVVSDDWGEYGSFNIAPYAVVKIDGGSSLDYYQLAVKIHDVYSYYEGSILVSEERVEWEIYKVSLDGVIDSSEKTHAFSIIPWEPKFGQDMNGDDDFSGTVNIKYRRTDSSGVDGVSIGEADGQLYIINGATQIAVQDPWIEDNVNWGDGGYQSTALAAELNDNGTTVTTDDYYQLAVKQTNTWTDYWGGGQTQTDINWQVYAIDSAGRIDWEKTIWTQSIAGFENFFGEDLNNDGTKGIDSGNLKDAELDKYGYRLKKDSDNLLYIVDENGENTMPVKDEYGGFPSFDHSHSYWGGSHLSSAIAVEQNADLSFSLAVKRQDSWDGETNTSWEVLNISQAGVLSWDNAQWLDDITLLETTLFNDDLDGDGATGLDLSALNVLSTDIETTSGRLYSNAAEDRYYIRDGNSTLAIAHEWGEPIDFSGKENWGSFEFSREPIAAESHSFTGSDGSTYDGYILAIKNTFVDSSGSELVENIDWEIEYVKPSGVVDDMLRTHTNGIKGKEKLFAQDLDGDTQIGLDITKLVSVSTDTTGDLLKTLGESLYIFNDKNTTTTDDDVVIEVVDASGFTPWFDWQETWGYGDYAQVESASAYSVESLEDSEGNTNFLLGIKISSTYAGVEDTFWETFKIKESNPGEGDWYLDWDTGSFSKGSRRLESIFNQDLNGNGVVDSGSVSTQNVSTDTSTSGSRGAALAIDDEGSLYIKRGTNNPILIEDDNGPVTFDWNDAWGGYTRTSSAFAVEGLLNDAGTAIGSYKLAVKYQETDQRTDTTSTYWETFIVSSEGKLDWGSATWGKIKRHEGDLNEDMDGDNAIWSEANVQYTAVDTDTIGSKPYLDPENYLYVQPSGSTTKSAVLTESGDAFLATESFSYGNFAFSQAPLAVKDVTIGSGESALSYYKLLFEQTITEGSSDPVKEYMTLNIDQVSMKVDWATETYFFSHETLEDQFRLDLNDDGSVFEVNANSTTAIATDTAGAKLRQTSDGSLFIKDGENSAFAVTYADGLPVDLDVQETLSDVLSRSTKAIAVQKSGDLYKLVVKETTGLTVDGVETSSVVYVVYDVTTAGIFKPSSALYRTEAELNETTWSQDITGDGVVSQGSTSSASDAFADAVGTDVSQEVVDKFQNSSASDILSVKAADGSNPLSIFVPTGSGAKSNVDLTVKQVQSVDAPLMAKAVYDAGLTAQVQSRRAKTTDTSYEAVTGLLDTQITVTNQAKFGKIQSVSWVLPEDVGADPTYIAKNSVTGEFTNLQYDAETGEGAQWDETDRTLTLFVRDNGKNDESDDQGTIRTPGFVAARSSGTTSDSTTPTPTPSVTPTPTPSATPTPTPTPTPTPTPTPTPSATPTPSPSATPTPSPSATPTPSPSATPTPTPTPTPTPTPSATPTPSPSATPTPSPSATPTPSPSATPTPSPSATPTPSPSATPTPSPSATPTPSPSATPTPSPSATPDPTPTASDELPVDVSDLGSDDISSLTPDAVSELTAEQVNDLSPSAVQGFTAEQVSELSEETVAGFTAQQVQKLAPEAVAGFSKSQVSELTPTSLKGLSSEQMRVLPASAVEGLTAKQVSKLSEEAVSAFTPKQFKKLAPEAVAGFSKAQVSELTPKTIKVLGSEQVEQMPKRSFQALDTAQLAKLSKDAVTGLTSGQLRTLSGAEISAFKPAKIKSLDADAISGFKPATLNDFSRRQVKALSDDQLAGLTKKQIKKAGDFVDALTDRQIGALSFDPGRSNRLIDPLDDQNYSSLLSGLDLETLA

SEQ ID NO: 5660 - protein, 113 aa, Pelargonium x hortorum
WRKYGQKMAKGNPCPRAYYRCTMAVGCPVRKQVQRCADDRSILITTYEGNHNHPLPPAAMAMASTTTAAASMLLSGSMPSADGIMNPNLLARAMLPCSSSMATISASAPFPTV

SEQ ID NO: 5661 - protein, 239 aa, Vitis riparia
MESERDQSSPSSSSSSSQTKCSISSSPVHKRKAGRKKFRETRHPVYRGVRQRNGNRWVCEMRDPKNKSRIWLGTFPTPEMAARAHDVAALAFRGDFAALNFPDSTSRLPRAKSSSAGDIRVAALAAAMAFRPAAPSSSSSYISHVTACSEELETSCSEDSPQLESRKKVVGVALEDSESSEGSPHGSSTVFMDEEALFNMPGLINSMAEGLLLAPPTMLGGFSWDDTTSYTDLSLWNDD

SEQ ID NO: 5662 - protein, 188 aa, Glycine max
MSTSKSVSSSSEDDNELRRGPWTLEEDNLLSQYISSHGEGRWNLLAKRSGLKRTGKSCRLRWLNYLKPDVKRGNLTPQEQLIILELHSKWGNRWSKIAQNLPGRTDNEIKNYWRTRIQKQARHLKIDTDSREFQELVRRFWMPRLLQKAKESSSSAMSIQNQATPMPFDGVSQHSTVGTIPSHSHTPW

SEQ ID NO: 5663 - protein, 267 aa, Alpinia hainanensis
MEHKADQDRLLGFKGGKLEPPVAAVGRMGRGKIEIKRIENTTSRQVTFCKRRNGLLKKAYELSLLCDAEVALVVFSCRGRLYEYASSSVKSTIEKYKKACKDTTNDGFVSEANAQYYQQEASKLRQQINSIQISNRNLMGESLHSMNLRDLKQLESRLEKGIGKIRNKKNELLFAEIEYMQRREMELQSDNIFLRNKIAETDRVHQQMSMLPSTGATVAYEAMPTYYSGNFMQCKNRSQTNIYPQQRQRTFTSTPMRSKHGAWVLRG

SEQ ID NO: 5664 - protein, 322 aa, Glycine max
MNNPTLSRLFPGLNREREMSAMVSALTHVVSGEVPITGDSSSSSSLVLHHQPHDDTVIVTPTMPSSSSSSTYVVGTSSLKRSRENDTYTSSLFSHPPSSSPAMPTRAEYATREMGNSVYEYRTTTENATRDEGRRKYRGVRQRPWGKWAAEIRDPFKAARVWLGTFDTAEAAARAYDEAALRFRGNKAKLNFPENVTLRQPQFTVSNSPSSLVSITTSIDPVVHSTRPLLLPSQASTATNVYEYFQLSGFPTNTNLYDGNRMFVTSNAMASHHLQSSSSLLSSSSSAFVSSVTSQDTSLSSLYSGQLPPWSKVSGHSSSSSG

SEQ ID NO: 5665 - protein, 468 aa, Arabidopsis thaliana
  misc_feature (89)..(89): Xaa can be any naturally occurring amino acid
METEDDLCNTNWGSSSSKSREPGSSDCGNSTFAGFTSQQKWEDASILDYEMGVEPGLQESIQANVDFLQGVRAQAWDPRTMLSNLSFMXQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 5666 - protein, 248 aa, Cleome spinosa
MGRGRVELKRIENKINRQVTFAKRRNGLLKKAYELSVLCDAEVALIIFSNRGKLYEFCSSPNMLKTLERYQKCSYGSIEVNNKPAKELENSYREYLKLKSRFEGLQRQQRNLLGEDLGPLNSKELEQIERQLDGSLKQVRSIKTQYMIDQLSELQSREQMLLEANRALSMKLDEMVGARTHHIGGGWEGSEQNVTYGHQPQPQGLFQPLECNPTLQIGYNNPECPEQMTATTQAPAQAGNGYIPGWML

SEQ ID NO: 5667 - protein, 416 aa, Cleome spinosa
MASAKLSGPPGVSPEDDGEDQADIVPVSETDGETVAFPVFYQTDSRACNPYYPFSDSNSDSGSVSCPDAGPDPDGSFIDFFDESYEVGAVEEFYSDPDPGLRIVGDFNLWGFPDEEEDDVAELGLGLGLGPGTGSDQQRGDSGGQGLRVTGIDSDSDFEDGVFDLNASDDGNGANASGRVVDGTGTPPVWDSFFGEEAVVTNEELEWEEVQNAITWTHEPVEVRVLNRPEEEEELSSSSRISSRDDHEHDLDWQVLLAVNNVVNYIEQAEGISITADDIDANYYMYLASIDEYGENHGDFDAIFGQMLDTDTGISGSPPAAKRVVEDLPLVELTVDDLGKGDIVCAVCKDEMAIEEKVRRLPCRHFYHEDCILPWLGIRNTCPVCRHELPTDDPEYESARRLQRSGSGLARELSGR

SEQ ID NO: 5668 - protein, 324 aa, Picea sitchensis
MSARMKIDSATRHNANFFQYSSGGYACPSDDLVFSPNSLVQRPVSWVDTNLMNPDLSSTANSSCFPRINGGINGLSSSKTHSPPAPSHSLTEFMQTQSRAHDQGKNEHVNSMKNIQQQQQQDQMNQTTGNPNIWKPSWLSQTTTSDKEEAVQRRDFNVPGGFPESNSSGDTQARLSAMRGFTGLEGQYFPAVREEHNKGISESERLQLGENDGGNVKDNRSRSRGKLEKRIRRPRYAFQTRSQVDILDDGYRWRKYGQKSVKNNLYPRSYYRCTHQTCSVKKQVQRLSRDPEIVVTTYEGIHMHPSEKSMESFDHILNQMQFLS

SEQ ID NO: 5669 - protein, 413 aa, Vitis vinifera
MGSSEMDKAGKEKESKTPPTTTQEQSSTTSAGTVNPDWSGFQAYSPIPPHGFLASSPQAHPYMWGVQHLMPPYGTPPHPYVAMYPPGGLYAHPSIPPGSYPFSPFAMPSPNGIAETSGTTPGSMEADGKSSEGKEKLPIKRSKGSLGSLNMLTGKNNELGKTSGASANGVYSKSAESASEGSSEGSDANSQSDSQLKSGCRQDSLEAETSQNGSTCHAPQNGGPNTPHAMVNQTMAIMPISAPGAPGGVPGPTTNLNIGMDYWGAPTSSTIPAMRGKVPSAPVTGGIVTAGSRDSVQSQLWLQDERELKRQRRKQSNRESARRSRLRKQAECDELAQRADALKEENASLRAEVNRIKSEYEQLLSENASLKERLGEIPGQDDHRTGGRNEQHSGNDTKQTGQTGQAEHGQGGH

SEQ ID NO: 5670 - protein, 160 aa, Phillyrea latifolia
RGRGMGDDGYRWRFYGQKVVKGNPPPGGYYKCTYPACPVRGHVAHDLTPGVITPYEGPHNHDVPGAARGSGSHSINTPMPSKNNGNGGAGGTAIRPGAMTHHNNNNAMNKKGIHNLRLPSSEGQAFFTGEMLQPRGGSGPGYSGPGNAMLYMSLCQNALS

SEQ ID NO: 5671 - protein, 385 aa, Oryza sativa Indica Group
MEATPISVKPPSPVAAAPPPPPVQVPVPPPPPPPLPPAAAAVEPLPPQPVAVVVAEAEPCSMNQLALTPTPKRQKVEESADGNGCKHCACKKSRCLKLYCPCFAGGGYCSEKCGCQPCFNKALYAETVQTTRKVLLSRQKRMSLKINRRSEANAEAVVVFLTEKAGATEDAHHSSSSTPPRRGCNCKKSSCLKKYCDCYQDGTGCSLFCRCEDCRNPFGKNEGIMAEESKRFLYTGADLDHSEDEQDFIVERSPRLQSPISKESSFQQTPPHIRATNRDTHMFPQAISQWQPRSWHCSKRQSNDRVIDDSGEYKNSNHDWQLAKPEDSYSISRCVQILNGMAELSQVEKSVAPDVFLQAGNREIFISLNGDVRALWLKRKIQNLT

SEQ ID NO: 5672 - protein, 378 aa, Oryza sativa Indica Group
MDFSCFNPQPAISHGIPFDSFLLQDELHHHADLDHPFEAEGITVHGSELEGGSVLPFATLHDLDHEFFRRGSRKDFIDNASSIFLLNPKTEVSHLVRDVQVGAFGAYEMNGRLISRNKTSRKGIKKADAVKGHWTVEEDRKLVKLVEQFGLKKWSLIGGMLPGRVGKQCRERWFNHLRPNIKKDTWSEEEDMVLIQIHKEVGNRWAEIAKRLPGRTENSIKNHWNATKRRQFARRRNRSTSKSGSTVLQNYIKSLAISPQESQMNNERSESNPSDMMITQGTPCCFDGNNCSQSHTSEENIVPSCGDFAAEMWSGLFDTKEDEEDEAQYLLYDMDTHVDMNCIFSNMDYGSNIEPGLASVVKAECSAESWAVNLKETD

SEQ ID NO: 5673 - protein, 278 aa, Zea mays
MGRAPCCEKKGLRRGAWSPEEDQRLVAYVRQNGHPNWRALPRQAGLLRCGKSCRLRWINYLHPDIKRGNFTADEEALVVRLHRELGNRWSAIAAQLPGRTDNEIKNVWHTHIKKRLGGDDGGGTGGRQEKKARKSRTRTAGATKRPAADVDSSERQPASPGQSSSVSSGVTFSAAAVSSSPDNAAATSRQEEQLQVGGAGKAEMEMEMEMESFSSAEFPAIDDSFWSSADVTDLGLCAMDGDELGIAGPPSSSTRDQDMEFWLKMLLEAGDMRDLSVL

SEQ ID NO: 5674 - protein, 328 aa, Oryza sativa Japonica Group
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGAELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 5675 - protein, 103 aa, Triticum aestivum
REYLVEWRDGGDREWVKAPWVAEDLVKDFEAGLEYGVAEAVVDRRQAADGDGDGRWEYLVKWVDTEEATWEPAENVDAELVQEFERQQPGNGGAAPPAETFAG

SEQ ID NO: 5676 - protein, 227 aa, Medicago truncatula
MYPTTNSVSSSSSDMSLPNSEGSHWMSICNEEMRLAATTPKKRAGRKKFKETRHPVYRGVRKRNLDKWVCEMREPNKKTKIWLGTFPTAEMAARAHDVAAMALRGRYACLNFADSAWRLPKPATTQAKDIQKAATEAAEAFRPDKTLLTNHNDNDNDNDKENDMAVVATATEEQSMICMEEKEEGVMNMQEMWSNMALMSPTHSLGYYEYQYINEDFQDEEVSLWSF

SEQ ID NO: 5677 - protein, 270 aa, Oryza sativa Indica Group
MKVQCDVCAAEAASVFCCADEAALCDACDRRVHRANKLAGKHRRFSLLNPSASGRSPTSTTAPLCDICQEKRGFLFCKEDRAILCRECDVPVHTASELTMRHSRYLLTGVRLSSEPAASPAPLSEEENSSSFCCSADDAVPAPAAPATSHGGSSGSSSISEYLTTLPGWHVEDFLIDDATAEAAAAAAATSSGISANGPPCQGVTRIGGLQESAGYPAWMAQQQLCCDGLVAGDASPASRERWVPQMYADQLAAGSKRSRTSTASSYSYW

SEQ ID NO: 5678 - protein, 331 aa, Zea mays
MDGLHTELALGLLECGVVGSGGETAPFVAKTYQMVCDSRTDALVRWGRGNNSFVVADPAGFSRLLLPCFFKHSNFSSFVRQLNTYGFRKVHPDRWEFAHESFLRGQTHLLPRIVRRKKRGGGGGACSSGGDAPQAGCCISTMGEDHRPEADPDEKQEADAEAALLEEVQRLRQEQTAIGEELAQMSRRLQATERRPDQLMSFLDRLAEDPDGVTRNLVEQAAEKKRRRMQLAFQSQPARPPLPPAPPPPVLHPLLALGGAAAKGLDGWQWAELQKPSVVLPAFDFDPAASCCGAQHAPNLGGAGIIGMGLTADETTVETPFPFCLLGQGFF

SEQ ID NO: 5679 - protein, 285 aa, Physcomitrella patens subsp. patens
YGEVNKILASRVVDGETQYLIEWKDDHPDSWEPPANIANDVVYEYETPWWQAAKKGDDQKLQELLQDEGRDVNAIDENKRTALFFASGLGSEKCVKMLLEEGADVHWQDKDGFTALHIAAGYVHTSVVKALLAAGADPELEDEKGRSSLMLAQELLERTPRTNPMQFARRLALDQVVKLLDEAIYETVEVEQILDKRIVGNVTEYLVKWSDDSEESWETTENIAEDLIKDYEEGLEYGIAEKIVDKREVDGKAEYLVQWADSTENTWEPADNVADEIIAEFESQK

SEQ ID NO: 5680 - protein, 325 aa, Arabidopsis thaliana
MHSLNETVIPDVDYMQSDRGHMHAAASDSSDRSKDKLDQKTLRRLAQNREAARKSRLRKKAYVQQLENSRLKLTQLEQELQRARQQGVFISSSGDQAHSTGGNGGALAFDAEHSRWLEEKNRQMNELRSALNAHAGDTELRIIVDGVMAHYEELFRIKSNAAKNDVFHLLSGMWKTPAERCFLWLGGFRSSELLKLLANQLEPMTERQVMGINSLQQTSQQAEDALSQGMESLQQSLADTLSSGTLGSSSSDNVASYMGQMAMAMGQLGTLEGFIRQADNLRLQTLQQMLRVLTTRQSARALLAIHDYSSRLRALSSLWLARPRE

SEQ ID NO: 5681 - protein, 219 aa, Physcomitrella patens subsp. patens
MAKSKGAKKALDSYTVKGTQKVVKVGDCVLMRGQDPDKPPYVAKIEKIEADNRNNTKVRVRWYYRPEESMGGRRQFHGSKELFLSDHYDIQSADTIEGKCIVHTFKNYTKLDSVGTEDYFCRFEYKASTGGFTPDRVAVYCKCEMPYNPDDLMVQCETCKDWFHPSCMSFTPDQVKRMEKFVCPDCSLPDGDRKLRQSSPGSSPTPEHVHKPEAKRRKR

SEQ ID NO: 5682 - protein, 179 aa, Triticum aestivum
MQSQIVCHGCRSVLLYPRGAPSVCCAVCHAVTNAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 5683 - protein, 237 aa, Zea mays
RCCRVKNPSSNGVLTAAAAFSDSKAMRESGKAAAARPYKGVRMRSWGSWVSEIRAPNQKRRIWLGSYATPEAAARAYDAALLCLKGSDAVLNFPSSSASSTHRRADDSSGGRPDDDDPGASGGMSPRSIQRAAAAAAAAFGDAAGIGASATTTPTPASLSTQGSTDHAHQEHATASSSAADDSTGSPPGGEELWTDLEAFASPKSMDLIDTGAAPFPSSAWEEPEDDGELMRLWSFC

SEQ ID NO: 5684 - protein, 352 aa, Gossypium hirsutum
MGHHSCCNKQKVKRGLWSPEEDEKLINYITTYGHGCWSSVPKLAGLQRCGKSCRLRWINYLRPDLKRGSFSPQEAALIIELHSILGNRWAQIAKHLPGRTDNEVKNFWNSSIKKKLISHDHVPALASFADVHSSNHTEEAGFISLNANPNLILAAQQDQLYLSPTAPVLQSFGHHADLVHHHFPLTPMLPPPPPPSNTASFDPAWTLPFGPQHDQDDDQHHQVQVFNNEAAQNFVSDKLMNPPFDNPLMGPPTVPKLCEILEGNMVCNIPQTPSVSLENNIDPLVSRLSSCFPPIPAGSNYAHDMQVGASQMEYIDTIITSIPSSSSSSSLSALSSGQYLTNPNLPSSSWDP

SEQ ID NO: 5685 - protein, 352 aa, Gossypium hirsutum
MGHHSCCNKQKVKRGLWSPEEDEKLINYITTYGHGCWSSVPKLAGLQRCGKSCRLRWINYLRPDLKRGSFSPQEAALIIELHSILGNRWAQIAKHLPGRTDNEVKNFWNSSIKKKLISHDHVPALASFADVHSSNHTEEAGFISLNANPNLILTAQQDQLYLSPTAPVLQSFGHHADLVHHHFPLTPMLPPPPPPSNTASFDPAWTLPFGPQHDQDDDQHHQVQVFNNEAAQNFVSDKLMNPPFDNPLMGPPTVPKLCEILEGNMVCNIPQTSSVSLETNIDPLVSRLSSCFPPIPAGSNYAHDMQVGASQMEYIDNIITSIPSSSSSSSLSALSSGQYLTNPNLPSSSWDP

SEQ ID NO: 5686 - protein, 299 aa, Oryza sativa Japonica Group
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEDAALAYDQAAYRLRGDAARPQLPRQRRLPRPAPRLRRRQAPDALPEHRRRQERQEVLCLRLRRRNILRAHQQLLVAVLRRRVVLPGVRRLVALPVAVLRRHHGRDAGDRAGDAAARLQRGAVGRGRRLRPHQVPVLRDRLGLPPRRQLTPPPLLG

SEQ ID NO: 5687 - protein, 530 aa, Populus tremula x Populus tremuloides
MDELKIEERCLENKQLTPASSSSQSEEGSGSAILKSPGVYSPATVSPTNRRTTGPIRRAKGGWTPEEDETLRTAVATYRGKSWKKIAEFFPDRSEVQCLHRWQKVLDPELVKGPWTQEEDDKIVELVAKYGPTKWSVIAKALPGRIGKQCRERWHNHLNPDIKKDAWTLEEELALMNAHRIYGNKWAEIAKVLPGRTDNSIKNHWNSSLKKKLDFYLSTGKLPPISKNGFQNGTKDTNKSAVMKTMKESDSAAQTSSGTTDICKLDEDGKDQLESTLVLDVAASSSALPNEYADSVDLRCCDSELQQKFEDHQDKGIGSGLQFDRSTYGSLYYEPPLVEQLDSYPSNTGSVQHENNSCPVSSPIIFFTPPCVKSRDLSAQSPESILRIAAMSFPNTPSIFRKRKTAQVDLLPSKIGKAGEETVKDRLDMSVEHEKIENTLEKTAAQDGSLCESPASLGNGTIRPNDKPFNASPPYRLRSKRTAVFKSVERQLEFTFEKGRSDGTKPTRLSVKGGSPVTEDCSRATKMGVT

SEQ ID NO: 5688 - protein, 481 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSVRATPCTPYASSHRILHNLAGTDDLLRRRAAVQGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 5689 - protein, 395 aa, Arabidopsis thaliana
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLVQRNHLLDESHLSFLQLPQLESPKIQQDNSNCNSLPYGTSNIDNNSSHNANLQQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 5690 - protein, 270 aa, Populus tremula x Populus tremuloides
MGRSPCCEKAHTNKGAWTKEEDDRLVAYIRAHGEGCWRSLPKAAGLLRCGKSCRLRWINYLRPDLKRGNFTEAEDELIIKLHSLLGNSRWSLIAGRLPGRTDNEIKNYWNTHIRRKLLNRGIDPATHRPLNEPVQEATTTISFTTTTTSVEEESRGSIIKEEIKEKLISATAFVCTEAKTQVQERCPDLNLELGISLPSQNQPDHHQPFKTGGSRSLCFACSLGLQNSKDCSCNVIVSTVGSSGSTSTKNGYDFLGMKSGVLDYRSLEMK

SEQ ID NO: 5691 - protein, 282 aa, Glycine max
MSQRSVPAPFLTKTYQLVEDQGTDQVISWGESGNTFVVWKHADFAKDLLPKYFKHNNFSSFVRQLNTYGFRKIVPDKWEFANEHFKRGQKELLSEIKRRKTVPQSSAHPPEAGKSGGDGNSPLNSGSDDAGSTSTSSSSSGSKNQGSVETNTTPSHQLSSENEKLKKDNETLSCELARARKQCDELVAFLRDRLMVGPDQIDRIMRQGSCGSENVVGEGGGGDCLKLFGVWLKGDTLTDKRNNHKRGREDQMGFGGPRLKESKPVVDFGAVNIMMKSNRVCN

SEQ ID NO: 5692 - protein, 195 aa, Vitis vinifera
MRRGRATARDAPQQQEVRNQGKDVRFRGVRKRPWGRFAAEIRDPWKKTRVWLGTFDSAEDAARAYDAAARSLRGPKAKTNFPLSSPAVPQYQIQDQNHSHQHQPQRPTTSGMSSTVESFSGPRLSNPPSAPPRPRLRAPPVNDCQSDCDSSSSVIDECDGDLTSSSRKPLPFDLNLLPPSEDGDDDDLDATALCL

SEQ ID NO: 5693 - protein, 355 aa, Solanum lycopersicum
MESTDSSTGTRHQPQLPPGFRFHPTDEELIVHYLKKRVAGAPIPVDIIGEIDLYKFDPWELPAKAIFGEQEWFFFSPRDRKYPNGARPNRAATSGYWKATGTDKPVFTSGGTQKVGVKKALVFYGGKPPKGVKTNWIMHEYRVVENKTNNKPLGCDNIVANKKGSLRLDDWVLCRIYKKNNTQRSIDDLHDMLGSIPQNVPNSILQGIKPSNYGTILLENESNMYDGIMNNTNDIINNNNRSIPQISSKRTMHGGLYWNNDEATTTTTTIDRNHSPNTKRFLVENNEDDGLNMNNISRITNHEQSSSIANFLSQFPQNPSIQQQQQQQEEVLGSLNDGVVFRQPYNQVTGMNWYS

SEQ ID NO: 5694 - protein, 898 aa, Musa acuminata
MLILILAVFVPSYTEEPRCLNSELWHACAGPLVSLPAVGSRVAASTNKEVDSQIPNYPSLPPQLICQLHNVTMHADVETDEVYAQMTLQPLSAQEQKDPYLPADLGTPSKQPTNYFCKTLTASDTSTHGGFSVPRRAAEKVFPPLDFSQQPPAQELVARDLHGNEWKFRHIFRGQPKRHLLTTGWSVFVSAKRLVAGDSVLFIWNENNQLLLGIRRANRPQTVMPSSVLSSDSMHIGLLAAAAHAAATNSRFTIFYNPRASPSEFVIPLTKYVKAVYHTRVSVGMRFRMLFETEESSVRRYMGTITGISDLDPVRWPNSHWRSVKVGWDESTAGEKQPRVSLWEIEPLTTFPMYPSSFPLRFKRPWPTGLPFFHGGRDDEFSLNSPLMWLRDGGNPALQSLNFQGVGVTPWMQPRLGTSMLALQPDMHQTVAAVALQEMQTMDLTKQVTPAMLQFQQPQNTTSRSTPILQSQILQHAQPQSHQPLLHTIQGNQMQSQAQSQFLQHHLQQGHSFAEQQQQQQHNLQLQIPEHQQFQQQRVLPAYQQVPYGAANLSQLSSSSQSQSTTLNMISPSSQLKDFPDSNGNSVSASSVSPLDNILHQISPEETSQLLSLPRYAQPVTSNPWSSKRIAVESMLPSGAQSVLSQVEQIGSGQPNIPLQSVVLPPFPGRECSMNQDGNMDIQNQHMFGVNIDSSISVQNGIRSLGTGVNGTNSTNIPYAACNLLRSAGNDFPINQAVNGSNGLDESGLLQSTENVDRVNSQSGTFVKVYKSGSFGRSLDITRFSSYHELRSELGHLFGLEGQLEDPLRSGWQLVFVDREDDVLLVGDDPWQEFVNSVSCIKILSPEEVQQMGKQGVDFVNSAPIKRLQSNGCDDYVSQQHSRNLSAARITSVGSFKY

SEQ ID NO: 5695 - protein, 59 aa, Thlaspi caerulescens
SRKNRMKRTVRVPAISSKIADIPPDEFSWRKYGQKPIKGSPHPRGYYKCSTFRGCPARK

SEQ ID NO: 5696 - protein, 318 aa, Oryza sativa Indica Group
MASCRRGGGGDVDRIKGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRKHHSSLLADDLRPLKRTTSDGHPTLSSAAAPGSPSGSDLSDSSHHSLPSQMPSSPPHLLLPQHVYRPVARAGGVVVPLPPPPPPPATSLSLSLSLPGLDHPHPDPSTPSEPAVQLQPPPPSQMPPPTPSCVRQEPPQMPFQLQPPPPPRPSAPFSAEFLAMMQEMIRIEVRNYMSGSAAVDPRSSPDNGVRAASRIMGMAKIE

SEQ ID NO: 5697 - protein, 808 aa, Candida albicans SC5314
MSHLVSSSLGTTTTATPTSRSPHTNHSTPYNQNSITSNRSSPVPKNSVNSRIIPQTMNPPIDMKSNNILNPEKDTDTSRGDHSESKASSISSASGTTTTNNNNVSNNNSTGKTQIVFIHKLYDMLHDESISHLIWWSPSLDSFYVTPGEEFSRVLSQYFKHTNIASFIRQLNMYGFHKVNEPFLNQDDQQQQQQLQSNRWEFRHSTNQFRKGDTESLKNIKRRSSKTLNAQKEVVNIKSLPPTSHPMEYNTGYSYQNEDSAHYFVHHHSITTMQSPADMRPRSPSTPIPMQPLAQQQQQQQQQQQQQQQQQQQLPSQPVPNGPPVFSGPIPPGAVNQSPQEYLTRPSILNNVQGSFENATNFKFVELTNQINSLRNDFFTMNNRYEILQNELKYQTADSMAVLEILEKLSNDNRIATDIRDLKNVVSQRMQRLNNQFIPQQSNFAPHIPGQQQQQQHGNSVSSNYHLESTNVSRNPSTTNLNVAPQPYPLNPHYTIYANNRASGSSEINNGVFRAREDSNNSKRNLSVYDPLQPVPSRNSSRILIEESTPTHPPTNFNPQQSQSQSQVQLGPAMPPQGFRNRAESTYSPLSHSSNKSQILNKAPTPVNHSPLVQQQQKEAKQELNDSSVAPPSQSSLPVTRPLSRQQQQQQQTLHHPSTTSSRTNSLPNPVAEHPAPQSSYFMQRNSFNTIYEHQKSLRVPSPKRVRYATPPRSIPEQPISSTAPTTMITSTSKTTSTSGAAISRSENHSVVSLTGGALPSVSELDKSIRTGSSVSLPPIKSIKDNDNKNDNGNSDDNGNDHKKRKLE

SEQ ID NO: 5698 - protein, 126 aa, Brassica napus
  misc_feature (46)..(46): Xaa can be any naturally occurring amino acid
QAEDRELKGQLLRKYSGYLGSLKQEFMKKRKKGKLPKEARQQLLDXWSRHYKWPYPSEQQKLALAESTGLDQKQINNWFINQRKRHWKPSEDMQFVVMDATHPHHYFMDNVMGNPFPIDHISSTML

SEQ ID NO: 5699 - protein, 229 aa, Physcomitrella patens subsp. patens
MNHLRPKRKRSRAPKQGDEVESQRMTHIAVERNRRKQMNEHLAALRALMPGSYVQKGDQASIVGGAIEFVKELEHLLHCLQAQKRRRAYNDISTAVIPTSSRIAMPSLDQLQLPAPPIPLLAPASSSLLGMNEIVGEAKSDMASVEVKMVGSDQAMVKIMAPRRSGQLLRTVVALESLALTVMHTNITTVHHTVLYSFHVQISLHCRLNVDEVAAALHQTFSSLHSLQF

SEQ ID NO: 5700 - protein, 489 aa, Picea sitchensis
MVECGVLMCVCVGVFCRSLIMDSQNSGISAGDEVNLGNFNVKEEESMQMPRCPRPMEGLHCAGPPPFLTKTYDMVEDPLTDTVVSWSSTNNSFVVWNSHLFSSDLLPKYFKHNNFSSFVRQLNTYGFRKVDPDRWEFANEGFLRGQKHLLKLIQRRKPSCPPQFIDNLHHHHQQDQQQGMGACVEVGQFGMVGEIEGLRRDKSVLMLEVVKLRQQQQSTRNQLQTIGHRLQSTEQRQQHMMTFLARAIQNPTFLAQLSQNKQASKRLATSKKRRRLPKGEAQQDLPSFPASEGRIVKYQSSTSTPADSDHTQNSSNLEAFLSTMGHVDSPDMPTPHKTFQDREQDESSSSISMIAEQLYGFEPGSAFDISMPVDIPIETASAFDRNSVNLVGAEGEEDLDLENVNDVFWEELLNEHFDSQDDSGTEAEANFPDQDKGNFSSSSRSDVNLLAEQMGLTAFHQSIPIIPEKLIALESGLVSHSNLKNPSYF

SEQ ID NO: 5701 - protein, 246 aa, Cucumis sativus
MGRGRVELKRIENKINRQVTFAKRRNGLLKKAYELSVLCDAEVALIIFSNRGKLYEFCSTSNMLKTLERYQKCSYGAVEVTKPAKELESSYREYLKLKSRFESLQRTQRNLLGEDLGPLNSKELEQLERQLVSSLKQVRSTKTQYMLDQLSDLQNKEQMLIETNRALQIKLEEISSRNNIRLTWDGGDQSMSYGPQNAQTQGFFQPLECNPTLQIGYTSAVSDQITSTTTPTHAQQVNGFLPGWML

SEQ ID NO: 5702 - protein, 197 aa, Oryza sativa Indica Group
MGAIHVSPIRGSIPFDKCTDLDHAAPANLQSDLCKTATAIRSRPPDSYRHMQDQLICSGCRRVVQYRRGVAGVCCPGCNTLTAVNPSAVADMSELICSGCPTLLFYNRGASNIRCPSCNRLNSTRSANQIAHLTCGQCRTTLMHPPGASTVQCATCRYVNHVRDARPQTVLVENPKTLDDKGKLVSNVVVGVTSWKR

SEQ ID NO: 5703 - protein, 545 aa, Populus trichocarpa
MDSSSHQNWLGFSLSNHHHMNNTINIPTSSDSSHLCLFEAFNTTTTSAQEVNAVVAAGRATDISLFTASGPKLEDFLGGCTSTSPSQTPQQQPLCGQFSTETPVTTTATTLSDSTSSEIYDSELKTIAASFLRGFASTDHQKIDSTQKHQQLLVQAEHAPKKTVETFGQRTSIYRGVTRHRWTGRYEAHLWDNSCRREGQSRKGRQVYLGGYDKEEKAARAYDLAALKYWGPTTTTNFPVSNYEKEIEGMKHMTRQEFVASLRRKSSGFSRGASIYRGVTRHHQHGRWQARIGRVAGNKDLYLGTFSTQEEAAEAYDIAAIKFRGLNAVTNFDMSRYDVKNIANSNLPIGGISGKSKNSSESASDSKSIDGSRSDDRDLSSASSVTFASQPATSTLSFAIPIKQDPSDYWTNILGYQNTTTMNNAKNSSSSIVDPSTLLQSSTSGPAFQSPTVFKMDFNANSSVNESNNNGLLFNGGYTQQQISGIGTSSPSSNIPFATPIAFHSNGNSYEGNPSYSSWIAQPLHSFQSAKPKLSVYQTPIFGIE

SEQ ID NO: 5704 - protein, 340 aa, Zea mays
MGRGRAPCCAKVGLNRGSWTPQEDMRLIAYIQKHGHTNWRALPKQAGLLRCGKSCRLRWINYLRPDLKRGNFTDEEEEAIIRLHGLLGNKWSKIAACLPGRTDNEIKNVWNTHLKKKVAQREKKKAGAGSGDAGTPATAPLSSATSSTTTHNSSGGSDSGDQCGTSREPDATDVCPLQLEDMDVSDMLVDGAPPAAQPMPSPSSSSSLTTCVGGVEELIELPVIDIEPEIWSIIDGESAVARHGGDAAAPCTGTGTAVSTSEAEEAAANDWWLENLEKELGLWGYAEEDTQAHPDLLDHYTGLSPLCALEGDPVSTYFQTGPAAAEPELLVVVEPSAVLL

SEQ ID NO: 5705 - protein, 333 aa, Oryza sativa Indica Group
MGEQQQQVERQPDLPPGFRFHPTDEEIITFYLAPKVVDSRGFCVAAIGEVDLNKCEPWDLPGKAKMNGEKEWYFYCQKDRKYPTGMRTNRATEAGYWKATGKDKEIFRNHHMLIGMKKTLVFYKGRAPKGDKTNWVMHEYRLADASPPQPPPPPSSAEPPRQDDWAVCRIFHKSSGIKKPVQVPMQMPMQMQMPVAHQVPAANYQQQMAMASASIIQVPMQMQMPSMSDQLQMLDDFSTGSLMAPPPPPPSYSTLPGFPLQINGGAQQFVGNPSMYYQQQQQQQQQQMDMAAGGFVVSEPSSLVVSPQDAADQNNAADISSVACNMDATIWKY

SEQ ID NO: 5706 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTNEYENQQHRTTVSIGMDPELDQFMEAYCEMLTKYHEEL

SEQ ID NO: 5707 - protein, 408 aa, Oryza brachyantha
MAEQGAAEADAAGGGEPPPPVTAAAEALAGQRSLPTPFLTKTYQLVDDPAVDDVISWNEDGSTFVVWRPAEFARDLLPKYFKHNNFSSFVRQLNTYGFRKIVPDRWEFANDCFRRGEKRLLCDIHRRKVVAAAPPSPGMATAAAAVASGAVTVAAAPIPMALPVTRQGSPAHSSEEQVLSSNSGSGEEHRQASGSGSAPGVGGGGAVSASGDMGEENERLRRENARLTRELGHMKKLCNNILLLMSKYAATQHQDGSAGISSVVNCSGESSEAVPPPPPLPPAILDLMPSCPGLAATAAAAGLAIDVDPDASARLFGVSIGLKRARDDADDDSGPAAGGGGGGGEDWPEHGADVKPEAADPHPGGGSSSKEASPDQNTWPIYRPTPVYHSVRPACDRAGSDQDGSSSR

SEQ ID NO: 5708 - protein, 249 aa, Zea mays
MVKGAHFQDAAVDGGAGGNAEAAMQGGAKRQYKGVRMRSWGSWVSEVRAPSQKTRIWLGSYSTAEAAARAYDAALLCLKGSAAADLNFPVHLPFHVPAAAAMSPKSIQRVAAAAAASGGATCSPPQLQAGAAASAPYSAGAGAADGASPPCSYGDASSGVSSPETAGNTDDLCYGVAHDDDVDMVAGDADLAALADIESFFRSPKCMEYAMMDPCSTFFAPAPMATDAASEWEWEEEGQIDLWSFSSLN

SEQ ID NO: 5709 - protein, 398 aa, Physcomitrella patens subsp. patens
MDELDCELWHACAGPLTQLPPVDSHVMYWPQGHIEQVCAADVYQASKQFSNLPAHLLCKISKIELQADPHTDEVFAQMDLTPQYETEFTKEMKDAPPPTMQKNVRSFCKTLTASDTSTHGGFSVPRRAAEDCLPLLDHSMNPPCQELVAKDLHGKEWNFRHIYRGHPRRHLLTTGWSVFVSQKRLVAGDTVIFLRGENGQLRVGVRRASKQLPQTRSTHFSNANLHLGVLAAASHAATERLRFSVIYNPRTSPSEFVIPYHKYLKTKENNLTVGSRFKMKFESDESTERRYSGTIVEVSDADPLKWPNSAWRSMKVEWDESASERHERVSPWEIEPFVPISTLPTPSVGPRPKRRPPTFVTDSSPQGTSQSVLDPQQSNKLARILHSHDPRNEVEYRR

SEQ ID NO: 5710 - protein, 320 aa, Picea sitchensis
MMAQRLDISGGNDSSISELEQTNAHPDLTSKDIINLRKRKCLSNPKVKVADVHSIPPKTKETDETERNGKHYKVGESTKDKDDLKDKLEESNSAETAESCPKQTVDNAKPSSVSVKQDYIHVRARRGQATDSHSLAERVRREKISERMKLLQDLVPGCNKVTGKAVMLDEIINYVQALQCQVEFLSMKLAAVNPQLDCNVEGGYLTRDVLQPHCSSISKMFAPDTTAAASQINQLQKTPLQHGLQCRADRQELAIRGMMDTQFTCMNGYADPTFQLQMSQGWDDEFQNAVDIGLDQNRSNPLKSHGFHGVLPTGHMKVEL

SEQ ID NO: 5711 - protein, 613 aa, Chlamydomonas incerta
MMRRQRAAPFVGAVNVLIVALAFVASANAQCVPGGIFNCPPSPAPPSPAPPSPPPSPLPPSPAPPSPAPPSPTPPSPEPPSPAPPSPPPSPAPPSPAPPSPVPPSPAPPLPPSPVPPSPAPPSPVPPSPAPPVPPSPAPPSPAPPLPPSPVPPSPAPPAPPSPAPPSPAPPSPPPSPAPPSPEPPSPAPPSPPSPAPPSPAPPSPAPPSPAPPVPPSPAPPSPAPPSPPPSPAPPSPEPPSPVPPSPAPPSPVPPSPAPPSPVPPSPPIPPSPAPPSPAPPSPVPPSPAPPSPVPPSPVPPSPPPPPSPPPPPPPRPPFPANTPMPPSPPSPPPSPPPPTPPSPPSPPPPSPVPPSPAPGTPVPPSPAPPSPAPSPIPPSPAPPSPPPSPAPPSPSPSPSPSPSPSPSPSPSPSPSPSPKPSPSPSPSPSPVSVKLVWADDAIAFDDLNGTSTKPGSASRMIGEPNIASTQCKGNLNGWMPKPNKNPRWGQALFSGGRTVGSVANVTIRVAFVTQTPKLVYSSIELVVYNSGATGGGSTGAAIMRVPIAANVTRSAIKCPGFLTLAPVPVAGYPVGIDATTWPNWKIAGVRINMGVGNKKPKTSIDAVGLNLK

SEQ ID NO: 5712 - protein, 245 aa, Arabidopsis thaliana
REYNCNYLGKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 5713 - protein, 225 aa, Gossypium hirsutum
MRKGRGATAAADAAMKPAVEANGSVKELRYRGVRKRPWGRFAAEIRDPLKKTRVWLGTFDSAEEAARAYDAAAITFRGNKAKTNFPFNSSDFPAFGIDRHHRRNNEGFIADGHRFHQTGGDYEDPEVNPQRPARSSMSSTVESFSGPRPTQPPRKPSDFEAVSTRKYHPKMPRMAPEDCRSDCDSSSSVVDDGDDDNVSSSRRKILPFDLNFPPLDEVDDLTLSL

SEQ ID NO: 5714 - protein, 280 aa, Brassica napus
  misc_feature (264)..(264): Xaa can be any naturally occurring amino acid
DDAKLPTMEEFSVFLSSETQNLISNDNNNNHMIHQMIHGSNWDNSGLFMNTSVPNTTTTPTPDLLSLLHLPRCSVPLPSSNVSDILSGSCFTYDPLVHLNLPPQPPLVPSANYDYSGFFLDTNTTQRDQPTAGDENNNAQFDSGIIEFSKKIRRKGRRKQKNKPFTTERERRCHLNERFEALKLLIPSPTKADRASILQDGIDYIKELQRRVSELKYLVERKKCGGRHNNNNNNNNSDDCINEDTNDDENIVKKLESDVLDQCXSTHSLRCSWLQRKSKV

SEQ ID NO: 5715 - protein, 219 aa, Prunus armeniaca
MEKTECSEAENFGSVTTSLEPQATAKRKKAKSKNQRRFSDEQIRLLESIFEADSKLEPRRKVQVARELGLQPRQVAIWFQNRRARWKSKQIEQDFRTLRADYDNLASRFESLKEEKQSLLMQMQKLNELVGKPSQGLEGNIMVDGSRLQEELEPRGVIQSHKNNTSNDVGCHGDEIHELLSMAHVDASSLSPQDWHRFEPSILFDPSRFTSSHWLNFWT

SEQ ID NO: 5716 - protein, 431 aa, Triticum aestivum
MASMAVAEERDAMDSSRMPIGKGLSVDVAMEPNEEGMGEHPVKPRKPYTITKQREKWTEEEHEKFLEALKLYGRSWRQIQEHIGTKTAVQIRSHAQKFFSKVVREPGAKIEIEIPPPRPKRKPLHPYPRKRANSCNGANAANGQPKLAHMSSSSGSDQENGSPVSVLSAMQSDAFGSSMSNPSSRSTSPESSDEENNVPPMVNGGEGQQTGVDQSHKEADQENKDTGTSEEDSSDEVQVTSVKLFGKTVVIPDPRKRCSPDTGSGHENGEQTSEFSNKATSQAPFAVEIQAYAAPPSAWVLPYNSFPLHFGESAEARIARLHMWWPYYGFPMVHPSGPSAVAHNGKATDESEAAKSPPVESSSDFVDNTQATASKQWKVLESLGTAQAPPSVSNFQLKPSTNSAFVRVKPIISSGDEPARGFAPYKRCRVE

SEQ ID NO: 5717 - protein, 159 aa, Physcomitrella patens subsp. patens
YCECFALGVYCVGSCACRDCFNKPEYIETVINTRQQIESRNPLAFAPKIVQGAEPSPVPGVTLPAAEACVQLVVQDEALDTPASARHKRGCNCKKSLCLKKYCECYQAGVGCSEGCRCEGCMNKYGKKEGLCFDTDCYFLYSGGLFITVLKSPLNQYLK

SEQ ID NO: 5718 - protein, 267 aa, Morus alba var. multicaulis
EAVQQENLSQLASDTVHYNPSDLSTWLESMLTELNPPPNFDSVMAAPPPLAPSLPTATAATATAQQSALEDSFLAPAESSTITSVDYDYDLKAIPGKAIYSQTPNNLDSSSSSTTRESKRLKPSNDVVSTAATDSNRPIVLVDSQENGIRLVHALMACAEAVQSNNLNLAEALVKQINYLAISQAGAMRKVATYFAQALARRIYRLYPENPLDLPHADFLQIHFYETCPYLKFAHFTANQAILEAFQGKKRVHVIDFSMNQGMQWPA

SEQ ID NO: 5719 - protein, 417 aa, Phaseolus vulgaris
MGSSDMDKTPKEKESKTPPATSQEQSPPTTGMATINPDWSNFQAYSPMPPHGFLASSPQAHPYMWGVQHIMPPYGTPAHPYVAMYPHGGIYAHPSIPPGSYPFSPFAMASPNGIADTSGNNPGSIEVGAKPPEVKEKLPVKRSKGSASGGSLNMWITGKNNDLGKTTGESANGIHSKSGDSASDGTSEGSDENSQNDSQLKSGERQDSFEDEPSQNGSSAHAPQNGVHSRPQTVVNQTMPIPISTASAPGAVPGPTTNLNIGMDYWGTPTSSAIPALHGKVSSTAVAGGMITAGSRDGVQSQIWLQDERELKRQRRKQSNRESARRSRLRKQAECDELAQRADVLKEENATLRAEVSRIRSEFEQLRSENASLKERLGEIPGVATPGNEDVRSGQNDQHVSNDTQQSRQKEAVQGVH

SEQ ID NO: 5720 - protein, 359 aa, Zea mays
MGSNDPSTPSKASKASKQVLETVDQPPATTSSGTVSVYPEWPSFQAYQAIPPHGFFPPTVAANPQAHSYMWGAQPMVPPYGTPPPPYVMYPPGAVYAHPSTPPTMHPFSHYPMPTNGHAETPGTAPSAPEMNGKSEPGRTSAPSANGITSHSESGSESESEGSDANYENDSHSKDNDGKEDGNSQNSISYSASQGVLNQTMAMLPIQPGAMVGGVSSSTANLNIGVHYWEAPGSAAVSATHGKAPAGSARGDQWDERELKKQKRKQSNRESARRSRLRKQAECEELGQRAETLRSENSSLRAELERIRKEYEQLLSQNASLKEKLGGSSDPIPDMNEQNDGNGSDKKQSDSDAQPGSES

SEQ ID NO: 5721 - protein, 185 aa, Silene latifolia
LELPWKAPMGEKEWYFFSLRDRKYPTGLRTNRATEAGYWKATGKDREIHSSKTCSLVGMKKTLVFYRGRAPKGEKSNWVMHEYRLEGKFAYHYLSRSSKDEWVISRVFQKTGPGAAPTSSAGGTTGPKKARNGMSFYGEVCSSPSSVSQQLPPLLDSSPYGDCCSFDDPDDSATNQERARVLLLQ

SEQ ID NO: 5722 - protein, 397 aa, Phaseolus vulgaris
MGSSEMDKTPKEKESKTPPPTSQEQSSTTATGTINPDWPGFQAYSPIPPHGFLASSPQAHPYMWGVQQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTRGTSANGIHSKSGDSASEGEGTSEGSDANSQNDSQMKSGGRQDSFEDEPSQNGTSAYTSQNGGISTPATVVNQNVPIIPISAGGAPGAVPGPTTNLNIGMDYWGTPAPSNIPALGRKVPSTAVAGSRDSVQSQLWLQDEREIKRQRRKQSNRESARRSRLRKQAECDELAQRAEALKEENASLRSEVSRIRSDYEQLLSENTALKERLGELPANDQHVGNEAQQNGQTEGVQGGH

SEQ ID NO: 5723 - protein, 315 aa, Arabidopsis thaliana
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 5724 - protein, 164 aa, Cleisostoma racemiferum
IENKINRQVTFAKRRNGLLKKAYELSVLCDAEVALIIFSNRGKLYEFCSSTSMLKTLEKYQKCNFGSPESTIISRETQSSQQEYLKLKSRVEALQRSQRNLLGEDLGPLGSKELEQLERQLDSSLKQIRSTRTQFMLDQLADLQRREHMLCEANKALKRRFEES

SEQ ID NO: 5725 - protein, 102 aa, Coccidioides immitis RS
MPKEKSTRQTKGRRAEKKKKDPNAPKRGLSAYMFFANEQRENVREENPGISFGQVGKLLGERWKALSDKQRAPYEEKAAADKKRYEDEKANYNAHEDDEESA

SEQ ID NO: 5726 - protein, 321 aa, Ruscus aculeatus
MEAGNPSSFLGFGELGLSHLLPTSLLLPAPQQNPNEDYDNNILKAKIMSHPHYPKLLSAYINCQKVGAPPEVVARLEEACSSSLMIGRAASSSSSSAVGGDPALDQFMEAYCEMLTKYEQELSKPFKEAMMFLSRIDAQFKSLSLSSSSPPTTNSLNQDLERNNSSEEDVDVSENYVDPQAEDRELKGQLLRKYSGYLSSLKQEFLKKRKKGKLPKEARQQLLDWWTRHYKWPYPSESQKMALAESTGLDQKQINNWFINQRKRHWKPSEEIQTYVVMGDGERITSIISWKMASAIPTPWMSLQPLSDQNSSFSLHFPMSN

SEQ ID NO: 5727 - protein, 253 aa, Oryza sativa Japonica Group
MSGTPADGGGGGGGGGGGTGDDWFLDCGILEDLPAAACGAFPWNASPSCSNPSVEVSSYVNTTSYVLKEPGSNKRVRSGSCGRPTSKASREKIRRDKMNDRFLELGTTLEPGKPVKSDKAAILSDATRMVIQLRAEAKQLKDTNESLEDKIKELKAEKDELRDEKQKLKVEKETLEQQVKILTATPAYMPHPTLMPAPYPQAPLAPFHHAQGQAAGQKLMMPFVGYPGYPMWQFMPPSEVDTSKDSEACPPVA

SEQ ID NO: 5728 - protein, 184 aa, Brassica napus
MDQNSHDRPTAEAGLQLNSTENPSPGRSVPFAGGATSSSTSTSSGTALAVVKPAAKKPSKDRHTKVDGRGRRIRMPALCAARVFQLTRELGHKSDGETIEWLLQQAEPAIIASTGTGTIPANFSTLNATLRGGGGSTIFAQSSKSSPFHSTGMSLYEDSNGTNGSSSSASKLLSAATAAQNAAV

SEQ ID NO: 5729 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALSNEYENQQHRTTVSIGMDPELDQFMEAYCEMLTKYHEEL

SEQ ID NO: 5730 - protein, 378 aa, Oryza sativa Japonica Group
MDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 5731 - protein, 388 aa, Oryza brachyantha
MESQLQDRGDEEAGARGRSELAPGNAAFAGLVQAQEEGGDEEEEGAGARIQVEMAGGGGAAFGRLGYAAVLSPVASRLQGEGGGEAEAGKCGLAEMAGGGPFAVGVEQAAAHDGDLVPKPESELVPVEFLQGLAAVGAKPQPRNRDRHIKVEGRGRRIRMPVKCAARIAQLTRELGHKSDGETIRWLMQQSEPAIIAATGTGTVPAIATTVNGVLRIPTESPSAAAAHGEEPAPKRRRKLQPTRASAGVEPLAMAPPPALYYPLVADPLLQANGGGAISISSGLAPTSATGTPSGAAAAIPFIAMPAAASDGKQPMHYWAFQTNPDHHSFAAGAQPIDGSSFQPQPFYSVVHPINGADPQGQNVNADDQPAGGEEDDYEEATDSSSEE

SEQ ID NO: 5732 - protein, 140 aa, Viola pubescens
VAVIVFSHKGKLFEYSTNSGMEKILERYERYSYAERQLVAPDFDSQGNWTLEYNRLKAKVELLQRDHRHYMGEDLESMSLKELQNLEQQLDTALKHIRTRKNQLMYDSISELQRKEKAIQEQNNILAKQIKEKEKTITAT

SEQ ID NO: 5733 - protein, 338 aa, Solanum lycopersicum
AVLMMDELSKLHSAIVCSHSRRQQEVEVEAEAGPTIINNTTTSFAAVHHHYCQLEAAVAADHNHHQNNTKSTTNMSDLIKAQIANHPLYPNLLSAYLQCRKVGAPQEMTSILDEISKENNLISSSRHSSEIGADPELDEFMESYCAVLVKYKEEFSKPFDEATSFLSNIESQLSSLCKDNLITSTSFNNYISDEAGGSSDEDLGCEEMEAADSQESPANCEGDNELKEMLMRKYSGYLSSLRKEFLKKRKKGKLPKEARIVLLDWWKNHYRWPYPTEEEKNRLSEMTGLDQKQINNWFINQRKRHWRPSEDMKFALMEGVSAGSMYFDGSGGTGNIGT

SEQ ID NO: 5734 - protein, 347 aa, Oryza sativa
MTRRCSHCSNNGHNARTCPARGGGGGGGGVRLFGVRLTSPPEVAMKKSASMSCIASSLGSGGGSGGSSPAGTGRGGGGGGEGAAGYASDDPTHASCSTNGRGERKKGTPWTEEEHRMFLMGLQKLGKGDWRGISRNFVVSRTPTQVASHAQKYFIRQTNSSRRKRRSSLFDMVPEMPMDESPVVVEQLMLHSTQDEATSSNQLPISHLHEESEFTEPSLAALDLEMNHAAPFKTKFVLTMPTFYPALIPVPLTLWPPNVANVGESGTNHEILKPTPVNGKEVINKADEVVGMSKLTIGDGSSNSIEPSALSLQLTGPTNTRQSAFHVNPPMAGPDLNKRNNSPIHAV

SEQ ID NO: 5735 - protein, 244 aa, Glycine max
MEQTSEGEKGLLSFSLLFPQAQNLPILLKRRRMSSGATHWCHACRQPVVLDGRDAVCPYCDGGFVQELDELEGIAPHHTFCSQSGEFHQMPDIFDAIPAFMGQRGSDQRSRLMDDAVDNFMRHRTAGRNSNFDVRGRSGSRPVPERSWGVFSSGPYLIFHGQVPGSTFAAGSPRGGSRHVDFGDYFMGLGLEELIEQLTMNDRRGPPPAALSSIDAMPTIKITQAHLRLDSHCPVCKRKFELGT

SEQ ID NO: 5736 - protein, 248 aa, Cleome spinosa
MGRGRVELKRIENKINRQVTFAKRRNGLLKKAYELSVLCDAEVALIIFSNRGKLYEFCSSSNMLKTLERYQKCSYGSIEVNNRPAKELENSYREYLKLKSRYEGLHRQQRNLLGEDLGPLNSKELEQLERQLDSSLKQVRSIKTQSMLDELSDLQNKEQMLLEANRALSMKLEEMVGARTHQFGGAWEGSEQNVSYGHQAQSQGLFQPLECNPTLQIGYNNPVCSEQMAATTQAPVQAGNGYIPGWML

SEQ ID NO: 5737 - protein, 210 aa, Physcomitrella patens subsp. patens
MADTSVQGPQDTDQSQQGEPFLPPGFRFHPTDEELVSYYLTKKVLDSRFTVHAIAEVDLNKCEPWDLPVKAKMGEKEWYFFSLRDRKYPTGMRTNRATDAGYWKATGKDRDVFAHGRSHLVGMKKTLVFYRGRAPKGEKTNWIMHEYRLEGDGGHSLPPRDEWVVCRIFQKSSGAKRSFLFSDSQTSHHHHCCRNLRHSVLASCSRQCLP

SEQ ID NO: 5738 - protein, 583 aa, Triticum aestivum
NKFVQKSRLVPVRNSRDIVDPRVRNEVPKAKSEAVDKEPSMISCTKADLGSNFGAIADRWSPESVESGAFTGDAAANVMALSAAAFNKSAPDMYNLLDPMDVDVKPPPLVSSDSTGEMPLYGCKIHKSVSFPRGPKGGAEYSVDRENGDDDDKSSGCTHSSTATNRGFRPNCTADQSRVKKFLACKYRKVAPARMHKGDLSYSDADRKPSFRNKKMYYTRQRTQRSTFKRRKMLDRHSTLVSEEFAKSNAKRTTKVNAREPHAASLEANKGSNSMPFHGSCKSNDCHVKLKIKSFKVPELLIEIPETASVGSLKKTVLEAVNAMLGGGLRVGVLHHGKKIRDDSKTLMQAGIGHDDILDNIGFSLEPNCTRHSSQLAAPEDIEFLETVETTEPLARIAPADSSSKHGEVDASQELALTPLTANYQGNDHDSVHSPGGISSPEKASANSRAIVPVTPVDSSAGAIVPANKAKRSAEQGQRRIRRPFSVAEVEALVLAVEKLGTGRWRDVKLRAFDNAKHRTYVDLKDKWKTLVHTASISPQQRRGEPVPQDLLDRVLAAQSYWSQQQAKLQPKTPPLAEARLLT

SEQ ID NO: 5739 - protein, 317 aa, Oryza sativa Japonica Group
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 5740 - protein, 228 aa, Vitis vinifera
MAKTRPGKRDLDSYTIKGTNKVVRAGDCVLMRPSDTDKPSYVARVEKIEADNRNNVKVRVRWYYRPEESIGGRRQFHGAKELFLSDHYDVQSAHTIEGKCTVHSFKNYTKLENVGAEDYYCRFEYKAATGGFTPDRVAVYCKCEMPYNPDDLMVQCEGCKDWYHPVCVEMTIEAAKKLDHFLCSDCSDDEAKRSQNAFPTSPTADTKPGFNHZPCPYLRIFFIAWVRA

SEQ ID NO: 5741 - protein, 526 aa, Vitis vinifera
MQASQKHGISGRSGSFYSQPVPQDDQGMHFSGPTYCEQYGTHESSSATGSFPIYNSPSTVSFSPEGSPASQQDSQTYPSDQLHSPENGHGSPISGSCLTDDVNELRHKLRELETAMLGPDSDILDVHEVIPRELNKISLEREKWKQMMEVISRGDLKEVLVSCAKAVADNDILRAEWGISELRQMVSVSGEPIQRLGAYMLEGLVARLAASGSSIYKALRCKEPASAELLSYMHLLFEICPYFKFGHMSGNGAIAEAMKDESKVHIIDFQISQGVQWITLIQALAARPGGPPQIRITGIDDSTSAYARGGGPSIVGQRLSRFAESCKVPFEFHAATISGCEVQLEDLELRPGEALAVNFAFILHHMPDESVDTQNHRDRLLRLVKSLSPKVVTLVEQESNTNTAPFLSRFIEAMNYYLAVFESIDVTLPRDHKERINAEQHCLAREIVNIIACEGAERVERHELLGKWKSRFLMAGFTPHPLSSYVNATIKTLLQNYSDKYSLEEKDGALYLGWMDRALVAACAWS

SEQ ID NO: 5742 - protein, 362 aa, Triticum aestivum
MEEIGHHFGLGATAHGQHHSQLPWGSSPLSAVIAPPPQQQQQQQSAGYLAHSPLSLNTAPPSGSHGGGTGCSNPVLQLANGSLLEACAKAAKEPSSSSYAADVEAIKAKIISHPHYSSLLAAYLDCQKVGAPPEVLARLTAVAQDLELRQRTALGSFGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 5743 - protein, 89 aa, Picea sitchensis
MECTKQERRKGIPWTEEEHRLFLMGLAKHGKGDWRGISKNFVVSRTPTQVASHAQKYFIRLSSWNKEKKRPNIRDIISPNPGAVSRSRL

SEQ ID NO: 5744 - protein, 585 aa, Oryza sativa
MSARPPPPPRPRLALPPRSAAESLFTGAGDASPGPLTLASALFPSDPDGGGGGGGVMTSSSSSAAGATSFTQLLIGNLSAPPPPPPPPQQQQQREAARGGGVARAGPALSVAPPPTAGSVFTVPPGLSPSGLLDSPGLLFSPAMFDAFDVLDMFIPDKILPKRATRIKLDIYFVKTSPEGGFGMSHREALAQVTAQASHSPLRMFDHTEQPSFSAAPTSSEAMQHMNAAVNMTGISDMVMGPTNNENVAFQPAEASQRYQVNAPVDKPADDGYNWRKYGQKVVKGSDCPRSYYKCTHPNCPVKKKVEHAEDGQISEIIYKGKHNHQRPPNKRAKDGSSSAADQNEQSNDTVSGLSGIKRDQEAIYGMSEQLSGLSEGDDMDDGESRPHEADDHEGDSKKRNIQISSQRTSAEAKMIVQTTSEVDLLDDGYRWRKYGQKVVKGNPHPRSYYKCTYAGCNVRKHIERASSDPKAVITTYEGKHNHEPPVGRGNNQNAGNAAPSSSAQQNMQNLSKANWGLTVQKRRITPSTDFLGTPVAEVAHWYLVDFFRQILDACNSNSHTVPNVQEVIQQYHCLQFSYRYTELL

SEQ ID NO: 5745 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGRGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 5746 - protein, 468 aa, Zea mays
MDMNESGETGMEQGNASSGAPVDWQTQFNAAAFSCAPQQVPMMDSAFASAGLWASTSQAMALSDVVGAMSAARGGGFLAPVPGFLPQGLGHFAVDSGFIERAARTSCFSGGGGGVMGASAAAFGAAGQTVNNAFSGSSEALLLDHQKKDVVGEKGEPELGRDDGVLSPEAAGGGDCSSKGTSDSKKREKAQRGERSSCFADSANESVHSMDKGEESSPATTTAGAGPGKSRGKGEKEVPESQKEDYIHIRARRGQATNSHSLAERLRREKISERMKLLQDLVPGCSKVTGKAVMLDEIINYVQSLQRQVEFLSMKLATVNPRLDLNIEGLLSKDLLRFPGAPSSSLGFPPEMMHPQLLQLSQPGRLVQGAAAAAAGMANPDVFRRIMQAQLSAKDDSGGASQMLPHGSFGGVARAAYPSSSSALALGSHDYLRSMSRASQQDARRAGVSDAATVVLCCAVLGAAALQF

SEQ ID NO: 5747 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVVKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 5748 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANSHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 5749 - protein, 285 aa, Brassica rapa
MAAQRSVPAPFLSKTYQLVDDQSTDDVVSWNEDGTAFVVWKTAEFAKDLLPQYFKHNNFSSFIRQLNTYGFRKTVPDKWEFANDNFRRGQEELLSEIRRRKAVIAAAGKCVVVGSPSESNSAGDDHGSSSTSSPGSKHPGSVENMVADLSGENEKLKRENSSLSSELAAAKRQRDELVAFLTEQMKVGPEQIDQMIKGGGKKLKPAVEEEESDCEGCGGDNGGAAVEGEKGVAGEGLKLFGVWVKGERKKRGRDEKNFVVGGSHMTEIKNVDFHAPLWKSSKVCN

SEQ ID NO: 5750 - protein, 178 aa, Lupinus bracteolaris
SSSSSYHPFAFFNPENASSNNTFSHDLLSFPYNTPTTHHYHAPIPETPSNFADCAASAAMFKNDVSGSNFGFSNFLAKKPASKKDRHSKIHTSQGLRDRRVRLSIEIARKFFDLQDMLGFDKASNTLEWLFNKSKKAMKELARSKNSSSGVAANSFSSSDSECEVVSMINQDSIDATP

SEQ ID NO: 5751 - protein, 226 aa, Oryza sativa Japonica Group
MAKSRPPKRILESYTIKGSDKVIKHYGSSVSGDCVLMRASDTSKPPYVARVEAIEAAGSRGTNVRVRVRWYYRPEESMGGRRPFHGAKEVFLSDHYDVQSADTIEGKCNVHSFRSYTKLDSVNAEDFFCRFEYKSATGSFVPDRIAVFCKCEMPYNPDDLMIQCEECSDWFHPSCIGMTIKDAKKLEHFFCQSCTAENGKMAENSHEATAQSEEKVSFDVMEKLKV

SEQ ID NO: 5752 - protein, 153 aa, Zea mays
  misc_feature (16)..(16): Xaa can be any naturally occurring amino acid
MVKSTDGGGGSSSSFXPSVAPFLRKCYDMVDDSTTDSIISWSPSADNSFVILDTTVFSVQLLPKYFKHSNFSSFIRQLNIYGFRKVDADRWEYANDGFVRGQKDLLKNVIRRKNVQSSEQSKHESTSTTYAQEKSGLWKEVDILKGDKQVLAQ

SEQ ID NO: 5753 - protein, 99 aa, Ustilago maydis
MAKADTKTKSSTSTQKRTTKAKKDPDAPKRPLSAYMFFSQDQRERVKNANPEAGFGEVGRLLGAKWKEMSEAEKKPYNDMANRDKARAEAEKAAYNKRR

SEQ ID NO: 5754 - protein, 588 aa, Cryptococcus neoformans var. neoformans JEC21
MSTVTFENIFHGDSADLGKLRFNPVGFGWKAYQSEDNNPTTYNGSDIRHATWFRVARHFQLRLGMRNSEKPRISFDGFKRDDLDKIKRTLQEYFNITLETRDTSLKGWNWGEAQVKGSDLVFQVQGKTAFDVPLSQVANSNIAGKYEVALEFNPPSNYKFDPKDLNKRPPDEMVEMRFYIPGKSMKKAGSDAGSGGEETELDEEGNEVSAADAFHSLIKEKADIGAVVGDSIVVFEDCLILTPRGRFSIEVYADSIRLVGKSTDHRVPFTSIHRIFLLPKLDDLHVQLVLGLDPPIRQGATRYPFLVAQWPKDEVVNAELNLTDEELAQYPDLEKTYEATTFQVVSRVLKALTGKKVTPPGSLRNAQGLNGIRANVKAVQGELYFLEKGLIFISKQPILIDFSKTDSISFSRVGGGVASARTFDMRVVSKTGGADHVFSAINKQEVGPISSFLQSKNIRLKNEMEEAIVDIDEPFSDDDEEMESPSEDERPSKAKNDKSKTKPVKKAADDDEDESDDEDFEDESSDGGSPSESDSDDDSGMASDASDPMMEELRKKTQAKRTKAKETSGSGSEDEKPKKKKAKKDDDE

SEQ ID NO: 5755 - protein, 355 aa, Medicago truncatula
MNSETETPSSTTSFWCYSCTRFIHILNQNNVVCPHCQNGFVEEIHAGQSPAVSLFADGIQSSRRQTSRRRRRNAGGSRSPFNPVIVLRGPREDTTAGVGADAGGGDSEGNTSSFELYYEDSNGTDLRPLPPSMSELLLGSGFDRLLEQFSQIEINGFGRSENPPASKAAIESIPTVEITDSEMESEIHCAVCKEQFELGSEARKMPCNHLYHSDCILPWLSMRNSCPVCRHELPSDQNASESRISGQIDEEAVGLTIWRLPGGGFAVGRFAGGRRAGEIQLPIVYTEMDGNNSNEDSRRISLTVGSNRVRERRGIRRIFRNFLSFFGNVNLNRSFSGSLFRRSSRRRSRTWVTEE

SEQ ID NO: 5756 - protein, 443 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLALEKLNRSGSPDLCLSEPENQSPTSVLSTLGSDAFGTVDSTKPSEQSSPVSSAVAENSGDLVLSEPSDLVVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSAGPNQSGAATHLPWGSSCAVPCTQVHSPIPMKGRPLFNDRDLEGKETQKEGSSTGSNAESVDAEYLEIEAQSSRNVVEESVRVRASVPSLFERRANSTKRVKGFVPYKRCLAERGMSSSTLTGEEREEQRTRLCL

SEQ ID NO: 5757 - protein, 213 aa, Brassica napus
  misc_feature (180)..(180): Xaa can be any naturally occurring amino acid
  misc_feature (191)..(191): Xaa can be any naturally occurring amino acid
  misc_feature (205)..(205): Xaa can be any naturally occurring amino acid
MELPQPRPFKAQGREPTHDFLSLCSHSTVQTDPKQTPSSSQGSHLKTHDFLQPLESVGGSKEETSKIDTTSEPHATPPPLKHVLPGGIGTYTISSIPYFHNHQRVPKPELSPPMMFPASGCGGGVERNVVDAAAVASGFTLWDESGSETKGPTRKENSAGERANIRADVATTMGQWAAQXLTNNNTERFSXRSSSSQGSGLKSQXFMDMIRSA

SEQ ID NO: 5758 - protein, 321 aa, Oryza sativa
MDRQWRCLAAAASTSGNSKLPPLPMALGGAVEYGQLVHGAAAPVAPFFVDAEQQSLSPATAMVLGAGWYNYNLVTPSQAAQLHHRLRRAVGAAPCSMKRCGGMAAAAAGRLALVGPAPVQAKLYRGVRQRHWGKWVAEIRLPRNRTRLWLGTYDTAEDAALAYDGAAFRLRGDAARLNFPELRRGGRHHAPALSASVDAKILQATTTTTADTAAAAAPASTNTTPPPSPRVVKTEPGCCSVSEASTTTTADAADVSSTGSSPSPTSSNQAATATPPAPRPPPPLPETIQQLDFTEAPWDEADGFALRRYPSWEVDWDAILS

SEQ ID NO: 5759 - protein, 510 aa, Yarrowia lipolytica CLIB122
MLLKMDKVDYGGSVSVQRGYHHNGPRALGTLSSSRATKAPHKSKFRPRSAATVLLHSQGHGLCQQGSFRDACMLLGQDKGSGAIVSPKDDLHLADTTYKAGAEHTVHVSLPSLYQILPEYRLRAEDGVTDGEGRSKNGDSIKGAMSKNSHNMYGYSWDASQSGYKNAPVSPNGNNNAHNHTGLNNHANHSLNSVSPVNAVNPITSASPVNHLGAHTANLSGSQSETPTPSNHNSTLNHSPLNNNTPGTTTPNNGMNTMPTINSSVPPSMHTMPASTSANMSGLNNLNRQPTLNGHYSQGLSPPKHTVAPQNVQYPQHIGVGYSTPYMAGTVNNGGLPHMNNYNQYALRRYVDTNVYPKQQQGYQPNQPQLQQPVQPGVPPQMHSQQSMQLPPPHGLHNGYRQYDMVQPQMEPQRYNPPEQQQPTGDKRRRGNLPKSVTSILREWLNDHISHPYPSEYEKSLLLQQTGLTMSQLSNWFINARRRQLPAMQQQGAEKKRLEEGERPISQKYH

SEQ ID NO: 5760 - protein, 397 aa, Triticum aestivum
MEAKPGEASSPTATAAAAAPVAAAAAAVVPEATVSFQSPASVPPPTASHAPAPSPVEMVSSSGLFVPPGMMTAMVAAAGRGALSAGPLVKVGKKRGRPRKYGPDGSLIQPLNATPISASAPMSAAVAAGQYTPAAAVGAAMKRGRGRPLDFAAAAAKPYHHQLHQPPPQQFGFHFSSIGDMVACSAGGNFTPHIITVAPGEDVTMKVISFSQQGPRAICILSANGVISNVTLRQPDSSGGTLTYEGRFELLSLSGSFMPTENSGARSRSGGMSVSLASPDGRVVGGGVAGLLVAASPVQIVVGSFLPSYPMEPKQKKARVSAAPPLSQAPPAVQLSSADTHSSEQGQHSSAAPRMNVVTSSAYSADQNWASTVVQSAPAEASRSTSSGDLNLTASGS

SEQ ID NO: 5761 - protein, 189 aa, Triticum aestivum
DLNLSRDLLAGKYKDKLEESYMGPIHEVFTKVLCGLSGAKVTRPGSYRTCQGEYAVKTSLKSEHRLLYPLGKGFFFLPEPPMLILYEEVEFVGFGSYRREGAGKSDCYLDLLVKRKNGQEHIFRNIQRNEYFNLFNFINGKQLKTMNLGDEQSDEDEDFGSFMGGGGSSTDDDSSGDESESSESGGEKE

SEQ ID NO: 5762 - protein, 271 aa, Oryza sativa Japonica Group
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVSKAESRSKSKLSAPKDEEGSGDDEGEEEEDDHDNTLCGTCGTNDGKDEFWICCDNCEKWYHGKCVKITPARAEHIKQYKCPDCTNKRARA

SEQ ID NO: 5763 - protein, 282 aa, Zea mays
MPEGANFTGKSAFTSLQDHGTDKCSTGCFGHIESSSHTDHASSSLIRPQPLVLGNGVQKSKGTSFKLFGIPLGSPEKSEPLVSPPSVAYDGKLQTSPSEKGNQLDVVEVDNCSHPSKTVKPLDGPQSDSITENNQPSPEATLNIQNKVQSSSTRSCKKVHKQGSALGRSIDLTKFACYDELIAELDQMFDFDGELKSPCKSWLVVYTDNEGDIMLVGDDPWNEFCDMVHKIFIYTREEVERMNPGALNSRSEDSLSDSLGRGVASRDPRGGGSTSALDSENC

SEQ ID NO: 5764 - protein, 428 aa, Oryza sativa Indica Group
MGRHSCCYKQKLRKGLWSPEEDEKLMNHITKHGHGCWSTVPKLAGLQRCGKSCRLRWINYLRPDLKRGAFSQEEEDLIVELHAVLGNRWSQIATRLPGRTDNEIKNLWNSCIKKKLRQKGIDPNTHKPLAEVDRSKATPTISNDRTSESSDVDPSSGVALHNLSHLLSETAQSSELLPVKVTKPRTQAPGLARLKVPPKELFLDQLTSGHENLPSCRSSGPIPNFPFQQLLCYNNDFNSMDVGNRNSLWYNQNESSSSTISTVMPPVSPSTLSTSTGLNPSPDNANSRGTGIHNSQFYWDTNNPSSSSSTGSSGNNGLGFELQSTSSLLETNIFPWTDLAPEKDSQAQLEEELKWPDLLHGTFSEMPAPMQNLSQSLYEDVVKAESQFNMEGLCAAWSQNLLPQQHLPVVSDMYDKDLQRMSLSFENI

SEQ ID NO: 5765 - protein, 113 aa, Persicaria virginiana
  misc_feature (34)..(34): Xaa can be any naturally occurring amino acid
  misc_feature (46)..(46): Xaa can be any naturally occurring amino acid
  misc_feature (63)..(63): Xaa can be any naturally occurring amino acid
  misc_feature (66)..(67): Xaa can be any naturally occurring amino acid
  misc_feature (76)..(77): Xaa can be any naturally occurring amino acid
  misc_feature (82)..(82): Xaa can be any naturally occurring amino acid
  misc_feature (91)..(91): Xaa can be any naturally occurring amino acid
  misc_feature (94)..(94): Xaa can be any naturally occurring amino acid
  misc_feature (112)..(112): Xaa can be any naturally occurring amino acid
QGPRDRRMRLSLQIARKFFDLQDMLGFDKASKTXEWLFAKSKSAIXDLTASLPPHQRKGSLMXSSXXVSSTSTTTXXIEKDXEKFDFGDVXGNXDQPKSSKSSYSNPIAKEXR

SEQ ID NO: 5766 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTASYYFPTPNGSPGPNQSGAATHLPWGSSCAVPCTQVHSPIPMKGRPLFNDRDLEGKEAQKEGSSTGSNAESVDAELSGDKNMEIEAQSSRNVVEESVRASVPSLFERRANSTKRVKGFVPYKRCLAERGMSSSTLTGEEREEQRTRLCL

SEQ ID NO: 5767 - protein, 244 aa, Ginkgo biloba
  misc_feature (35)..(35): Xaa can be any naturally occurring amino acid
  misc_feature (70)..(70): Xaa can be any naturally occurring amino acid
  misc_feature (81)..(81): Xaa can be any naturally occurring amino acid
  misc_feature (85)..(85): Xaa can be any naturally occurring amino acid
  misc_feature (101)..(101): Xaa can be any naturally occurring amino acid
MGRGKREIKKIGNATSRQVTFSKRRGGLFKKAKEXSVLCDATVALIVFSATGKLFEYSSSNMNSILERYXKYPEAIERDIXTELXINVDDVELAELNQKYXNLSLVCRQMSGRDLEGLRFEQLENLEENLEIGLKHVRSRQNELMLMQIDDLEERGVQLSEENNNLQLQFDGILKSGSLAQLRDGNTLINFDQLENRDTSSECVSTPINMQSNDNAVDEDSEEYETSLQLRLFDPQWRERIRPP

SEQ ID NO: 5768 - protein, 382 aa, Zea mays
  misc_feature (142)..(142): Xaa can be any naturally occurring amino acid
MGSSGADTSSKPNKASAPQEQQQPATSGAATPAVYPDWSSFQAYPPIPPHGFFPSPVASSPQGHPYMWGAQPMIPPYGAPPYVMYPPGVYAHPSMASGAHPFTPYAITSPNGNADATGTTAVACDTDGKPSEGKDKSPTKRXKGTLGSLNMLTGKNPSEHGKTSGASANGATSQSGESGSDSSSEGSEGNSHNDSYKHSGQEQDGDVRSSQNGASRSPSEGKFNQAMAIMPMPSSGPVTGPTTNLNIGMDYWANTASSAPVIHGKVTPTTVPGAVVPAEQWIQDERELKRQKRKQSNRESARRSRLRKQAECEELAQRADVLKQENASLRDEVNRIRKEYEELLSKNNSLKEKLEGKQHKTDEAGLNNKLQHSGNDIQKKGN

SEQ ID NO: 5769 - protein, 338 aa, Oryza sativa Japonica Group
MAAAIDMYKYNTSTHQIASSDQELMKALEPFIRSASSSSASSPCHHYYSSSPSMSQDSYMPTPSYPTSSITTAAATTTSSFSQLPPLYSSQYHAASPAASATNGPMGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 5770 - protein, 446 aa, Solanum peruvianum
RMSVDVGAPSPRSIQMDEQVNPGEEYAPKIRKPYTISKQRERWSEEEHKKFLEALKLHGRAWRRIEEHVGTKTAVQIRSHAQKFFSKVVRESSNGDASSVKSIEIPPPRPKRKPMHPYPRKMATPLKSGTLASEKLNRSGSPDLCLSEPENQSPTSVLSTLGSDAFGTVDSTKPSEQSSPVSSAVAENSGDLVLSEPFDFAVEESRSSPARAYATSNPANQACVKLELFPEDNDFVKEGSDEASSTQCLKLFGKTVLVTDAHMPPTDETLTRSSFPAKYLPWDSECPRSTFSIVPPTPSYYFPTPNGSPGPNQSGAATHLPWGSSCAVPCTQVHSPIPMKGRPLFNDRDLEGKETQKEGSSTGSNAESVDAELSGEKNMEIEAQSSRNVVEESVRASVPSLFERRANSTKRVKGFVPYKRCLAERGMSSSTLTGEEREEQRTRLCL

SEQ ID NO: 5771 - protein, 456 aa, Zea mays
MIATTTTGSSAKAAAVGGKEARACDACLRRRARWYCAADDAFLCQVCDTSVHSANSLARRHERLRLRPTSPLQTPPPPTPASANRESHDEVVPAWFKRKARTPRGGRAKSDVRTLSRRLVVPHAAGGDSPDGRNDEGEFEAEEPEEEVLYRVPVFDPALAEFCSPQPLEDAAALASSCNEDGAVEDPAKTDRETPAAAPLVQFFPDGGHANFGPTDAELREFAADMEALLGYGLDDGNEESSSFCMETLGLLEPVEVGEDASRVKVETDAGSACEASGTLACALELLDPDASDEMLDIDFNYGSPQDTTTTENAASSSHTGTDGQFLQTSLSLTLNYEAIIQSWGSSPWTGGAERPHVKLDDSWPHDCTNMWVVGRGMVGHGGEDLLGTPRLGQGMDDVGREARVSRYREKRRTRLFSKKIRYEVRKLNAEKRPRMKGRFVKRATAGGSLTIAGLA

SEQ ID NO: 5772 - protein, 171 aa, Brassica napus
  misc_feature (104)..(104): Xaa can be any naturally occurring amino acid
MEQLKVELEEETVTYGGSAAASSSVGSSSSPRPMEGLNETGPPPFLTKTYDMVEDPATDTVVSWSSGRNSFIVWDSHKFSTTLLPRYFKHSNFSSFIRQLNTYXGFRKIDPDRWEFANEGFLAGQKHLLKSIKRRRNMGLQTVVNQQGSESGMSCVEVGQYGFEREVERLK

SEQ ID NO: 5773 - protein, 248 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGKEAEAIKAKILAHPQYPSLLGAYIDCQKIGAPPEVVARLDALTHEYENQQHRTTVSIGMDPELDQFMEAYCEMLTKYHEEL

SEQ ID NO: 5774 - protein, 218 aa, Brassica napus
  misc_feature (202)..(202): Xaa can be any naturally occurring amino acid
MIMFESRSSVRGSNSVPDLSLQISLPNSHAEKPLHGSERSFTTSSDSGSSLSELSHENSFLKKHLLSLGFDHHHPYHHHQRHSSNMFQPQIYGRDFKRTSSSVVSLKRSIRAPRMRWTSTLHAHFVHAVQLLGGHERATPKSVLELMNVKDLTLAHVKSHLQMYRTVKCTDKGSSGERKVEKEAEQKTEDNNNNNEDADADXNSPNSPSVQKTKDLLV

SEQ ID NO: 5775 - protein, 132 aa, Brassica napus
MDMTSSSGKRSVAKKMTTPCCTKMGMKRGPWTVEEDKILVSFIEKEGEGRWRSLPKRAGLLRCGKSCRLRWMNYLRPSAKRGGIAPDEEDLILRLHRLIGNKWSLIAGRIPGKTDNEIKNYWNTHPRKKLLS

SEQ ID NO: 5776 - protein, 651 aa, Zea mays
  misc_feature (81)..(81): Xaa can be any naturally occurring amino acid
  misc_feature (109)..(109): Xaa can be any naturally occurring amino acid
  misc_feature (355)..(355): Xaa can be any naturally occurring amino acid
MMGGGLMMDQSVVFPGVHNFVDLLQQNGDKNLGFASLMPQTSSGDQCVMGEGDLVDPPPDSFPDAVEDDSDDDVEDIEELXRRMWRDRMKLKRLRELQQSRGKDPMASXVGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKMHPGARPPASTGGXIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYGFLDRNARNSHQYTCKYNDPITQSAENKPLPAPPQPQAFQPAFSQANQAANNLDFSLPMDGQRSIAELMNMYDTNFMTSKTMSSSDSVTIMERPNAMPQRIQMDEGFFGQGNGVFDDVNSMMQQQQQQAPPVVQQQQQQQQQFFIRDDTPFMSQMGDITSTAEFRFGSGFNMSSTAAAADYPGAAQKNDGTNWFY

SEQ ID NO: 5777 - protein, 284 aa, Physcomitrella patens
MGRGKIEIKKIENTTSRQVTFSKRRGGLLKKAHELAVLCDAEVALVIFSSTGKLFEYASSGSIRDIIDRYKKGSDGMQNGARNDFMGCEVVKLREQLEQLKASHRHMLGEDLSLLKVPDLLQLEQQLDLGASRVRARKNQLILEEVESLRRKEHELLIANEDLRQKLADAQGIADAVTARANVSESPRPLTSALTRDIVMSSQQQEVTVHPHPNLRDAQRSQTSLQLGMFSSESYLPSSSRGPSEHPIPVGPEGCAGESAMRWEHPHFHSQNRLHANISPSVRI

SEQ ID NO: 5778 - protein, 347 aa, Triticum aestivum
  misc_feature (79)..(79): Xaa can be any naturally occurring amino acid
  misc_feature (109)..(109): Xaa can be any naturally occurring amino acid
  misc_feature (143)..(143): Xaa can be any naturally occurring amino acid
MSEASVVNQAEVEDAAAAAAAGLDLPPGFRFHPTDEEIISHYLTPKALDHRFCSGVIGEVDLNKCEPWHLPGKAKMGEXKEWYFFCHKDRKYPTGTRTNRATESGYWKXATGKDKEIFRGKGLLVGMKKTLVFYLGRAPRGEXKTGWVMHEFRLEGKLTHPLPRSAKDEWAVSKVFNKELTATNGAMAAAEAGIERVSSLGFITDFLDSGELPPLMDPPLGGDVDEVIDFKSTSAYATGAHSGLQVKMEQHMPQQPPHMMYSSPYFSLPAANSGDMSPAIRRYCKAEQVSGQTSALSPSRETGLSTDPNAAGCAEISSAATPSSQNQDFLDQFDEYPALNLADIWKY

SEQ ID NO: 5779 - protein, 406 aa, Solanum lycopersicum
KGVKGDEDSNSQEQASSTATGTANPEWPGFQGYSPMPPHGFMASSPQAHPYMWGVQHLITLWYSTTSLCHYVSHGGIYAHPSMPPGSYPFSPFAMPSPNGVAEVAVNTSSNTELDGKSSEVKEKLPIKRLKGSLGSLNMITGKNTELGKTSGASANGVYSKSAESGSEGSSEGSDANSQNESPMKSAGRQDSAEERSQNRNSAHSSQMRTSAPHSLSTKLCNHANVSCGCWRYSWPHNQLEYWYGLLECRSFADIPAIHGKVPSASVAGGIGNAGSRDIVQSQMWIQDERELKRQRRKQSNRESARRSRLRKQAECDELAQRAEVLKEENASLRAELSCLRSEHDQLASQNASLKERLGEVSGRDDPRPSRKYIHLNKDTQTSSQTEPTGVSEVLARLCDEMAYYN

SEQ ID NO: 5780 - protein, 341 aa, Zea mays
HASGEILAEKYKDRLESSYRGLIHEVFSKVLRGLSSAKVTRPSTFRSCLDGYAVKSSLKAEDGLLYPLEKGFFFLPKPPTLIPHEEIEYVEFERHGAGGASISSHYFDLLVKLTNDQELLFRNIQRNEYHNLFNFISGKHLKILNLGDGQGRTSGVTAVLQSTDDDSVDPHLERIKNQAGNEESDEEDEDFVADKDDSGSPTDDSDAEGSDASMSGGEKEKPSKKEASSSKPPVKKKQKSGPDEGSQKKKPKKKKDPNAPKRAIAPFMYFSKAERANIKSSNPELATTEIAKKLGERWQKMTAEERQPYVEQSQVDKQRYAEESAAYRGAAAQQGSGAGSE

SEQ ID NO: 5781 - protein, 285 aa, Arabidopsis thaliana
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 5782 - protein, 513 aa, Glycine max
PRVRPRVRTAARRRQKGAQEDETLRNAVAVFKGKSWKKIAEFFPDRSEVQCLHRWQKVLNPELVKGPWTQEEDDKIVELVSKYGPTKWSLIAKSLPGRIGKQCRERWHNHLNPDIKKDAWTLEEELALMNAHRIHGNKWAEIAKVLHGRTDNAIKNHWNSSLKKKLDFYLATGRLPPIPKNSPQVPVKDTIRRSASKSMLGCSNKELNAAVETSSETTAISKLDDSGRNQFESSGTVREVGDSSSVPANDSADSDCVECKPGSSNINPSCSNSEHVSRANFGTTFGPISENSGLNGNSTFEHCTNNGDRSSTRLIGTSSQENPTCGSLCYEPPQLDGSVPIDSLYLNYTCQQNEYCPSPTMSPTGFFTPPRAKGSELCTETPESILRKAANTFPNTPSILRRRRTGAQTLTSPTKVLKVDNNPHTSNKTERTNDDSGSGHFSGSPASHGYGIGIPNNKAFNASPPYRLRSKRTAIVKSVEKQLEFAFDKEKNDDKRSNVMTEDRLHEKKLVVT

SEQ ID NO: 5783 - protein, 405 aa, Orobanche ramosa
MAPDVSGGLRNCAQSNTTNNNNNHVLKKGPWTTSEDMILVEYVKKHGEGNWNAVQRNSGLLRCGKSCRLRWANHLRPNLKKGAFTPDEEKLIVDLHSKLGNKWARMAAQLPGRTDNEIKNYWNTRLKRRQRAGLPIYPQQLLKQQQHHHHQQNSSSHIPSNLNPLIYYDALTSPPLINPSPNQLKIYGSNSGGVALSLAGSNSSSFFNQGISNQLPYLLRYDDDFDYGTGSEMGVLGLPSIQSPAPADSSSDFVMGSDCVEDYEVEMTGGGRSKSGLLEDLLGESHALAKTDDDDNMHEKGEEDFRFGNGSSDNNYEDLRTRVSEAENSSADDDLLNLLDNFPLSVPIPNWDEVHGNESPMLSNGTCGVVESQPEAARYNTVTTFTNEDRNFGSCLWNNMPAFTS

SEQ ID NO: 5784 - protein, 317 aa, Brassica napus
MGYMCDFCGEQRSMVYCRSDAACLCLSCDRSVHSANALSKRHSRTLVCERCNAQPATVRCVEERVSLCQNCDWSGHNNNNNNSSSSSSNNHKRQTISCYSGCPSSSELASIWSFWLELAGQSGWEQEMGMMNIDEEGQGNQNCNEDKKDVVAGSSSRPETSSAAPATSSFPKDVRVCEDDFYGNLGMDEVDLALENYEELFGTAFNTSGELFGQGGIDSLFQKHHQAAAPDGGNLVHPAESNDDSFMSSKTEPIICFTSKPAQACSDCSLRRFLRWRSVFLLPRLPFLRRLPGDHRWWFRRRICCRWRCSSWRRWWR

SEQ ID NO: 5785 - protein, 291 aa, Vitis vinifera
MANRWWAGQVGLQGVDTSSASPAMKKPDLGISMNENGGSGSGGGGEEEEEKENSDEPREGAIEVATRRPRGRPPGSKNKPKPPIFVTRDSPNALRSHVMEVANGSDITESIAQFARRRQRGVCVLSASGTVMNVTLRQPSAPGGAVMALHGRFEILSLTGAFLPGPAPPGSTGLTIYLAGGQAQVVGGSVVGSLIAAGPVMVIAATFSNATYERLPLEDEEEAGSAAQEQLAGGGGGGGSPPGIGGSGGQQQAGMADPSSMPVYNLPPNLLPNGGQLNHDAYGWAHGRQPY

SEQ ID NO: 5786 - protein, 246 aa, Glycine max
MVHAVSSTPSPVSSNNVVVVVADKKKAIEILQAKLLCASAFAPKTSPTSLRPISLSHRLTPTPPLKTRRGFLNDDDFAYSLCPSPLSVCFPHETSTLQNHVRGGDTKYDGRMHSYPYKKNGPYTCPKCGHVFETSQRFAAHVSSSHYKYETKSERKKRLMAKIRKRNLRIEWVSGGLTVVPDDAPPTSAFAYSARNNNNVAPPPPVRVVKVEGQSGMELQLAPPPGWEKLTAGGGAVKIKLEPVAS

SEQ ID NO: 5787 - protein, 157 aa, Daucus carota
QGRLSQEQSYRGVRKRKWGKWVSEIREPGKKARIWLGSYEAPEMAAAAYDVAALHLRGSAAHLNFPEMVGSLPKPVGSSHADVQRAAQEAAMSMRFGRSENRGPVTVQLSSSEIRAINESPLDSQEMWMEMGGSVFVEERRDDEELEEMQCSSLWKF

SEQ ID NO: 5788 - protein, 110 aa, Scaevola chamissoniana
TAQGFRDRRMRLSLEIARKFFDLQDLLGFDKASKTIEWLFCKSNKAIKEVMESSNSQYTNQSMSEEIKRSISPLSECEVESTMENTATTNKGGNLRGQSRKRTQTNPLAR

SEQ ID NO: 5789 - protein, 417 aa, Gossypium raimondii
MKESDKSLDPQLWHACAGPMVQIPPLNSKVFYFPQGHAEHSLAAVDFPSSPPVPALVLCRVASLKFMADTETDEVYAKILLMPLPNTELDLEHVAVFGSDNAEKPASFAKTLTQSDANNGGGFSVPRYCAETIFPPLDYTEDPPVQTVVAVDVHGETWKFRHIYRGTPRRHLLTTGWSTFVNHKKLVAGDSIVFLRSENGGLCVGIRRAKRGTGNGPEAGSPFLSFLREDESKMMMMNRNGDWRGKGKLKAEAVLQAATLAASGQPFEVVYYPRASTPEFCVKASSVKAAMRVPWCCGMRFKMAFETEDSSRISWFMGTVSSVQVVDPIRWPNSPWRLFQLEELSTQVPQGLAWDNIGGPSIPPYNRLTAAQFEAFFHPPGANCSSQIGYSNDVVSDEMNGAVHSQNVNGYFPGWML

SEQ ID NO: 5790 - protein, 108 aa, Scaevola chamissoniana
YTAQGLRDRRMRLSLHIARKFFGLQDMLGFDKASKTIEWLFCKSRKAIKEVTESLQSEKEETSQSVSREIHWSKLPSSECEIESTTEITAARNKDKNSKGEIKHRESR

SEQ ID NO: 5791 - protein, 120 aa, Scaevola aemula
YTSQGPRDRRVRLSIGIARKSFDLQEMLGFDKPSKTLDWLLTKSKAAIKDLVLKKQNEGSASAKSISSPSECEVVSAGNVETFEYGNSSLADSMRKSSNKCKGVKDPQQVAASNLAKESR

SEQ ID NO: 5792 - protein, 90 aa, Kluyveromyces lactis
PAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 5793 - protein, 253 aa, Oryza sativa
  misc_feature (120)..(120): Xaa can be any naturally occurring amino acid
  misc_feature (141)..(141): Xaa can be any naturally occurring amino acid
  misc_feature (168)..(168): Xaa can be any naturally occurring amino acid
  misc_feature (216)..(216): Xaa can be any naturally occurring amino acid
MAKTKQGKKDVESYTIKGTTKVVRVGDCVLMRASDTEKAPYVRRVERLETDGRGSVRVRWYYRPEESKGGRRQFYGAKELFLSDHFDTQSAHTIEGKCVVHSFKNYTKLDNVGPEDFFCXRFEYKAATGAFTPPPPPLDHXLSACCDAMWALVVLIMVGGFGLGVCVXCVCVCVQVLQVREMPYNPDDLMVQCEGCKDWFQPSCMGMTIEQAKILXHFLCADCVKENGTKRPSNSYPASSNSDSKVEPKKRKR

SEQ ID NO: 5794 - protein, 392 aa, Glycine max
MPFPWKKNRVPRISQFVADLQSPKRGGSLVVETGFPTSLIDLFVKNQSRFQKHRSKKPPPPKSLSATDPPPPPPPPPPSPATSPPPSRVPAVPTTPVEQDDTAVSAPDRITECSGSHWSRVNAVVLVAKILMVLVLVASVERLTVGITASAFALLLLEYAGLRRAVVSCSVAESRWRWFQKVSRKERVVVERIEFEFAELNKGLSIDEIEVVGTTNEGGICCSEIGDVASKVLEPCLCDEDVSECKIRPSRSGRFRSKMVKLVSKKFRGSKKKNKHNEGESGSEISSAVGEEKLPILEIEEEEEEENGDNKSSNTKPDCGITCSYEKKVNRVENSGSSMVLVMIIALVGLLLGRFPALVLLMTWCCLMKILGILWRTQKVPMNMIKCSVSNS

SEQ ID NO: 5795 - protein, 249 aa, Diospyros kaki
MGRGRVELKRIENKINRQVTFAKRRNGLLKKAYELSVLCDAEVALIIFSNRGKLYEFSSINNMPKTLERYQKCSYGTLEDNRSAKEMEQNSYREYLKLKAKYEELQHFQRHLLGEDLGPLNLKDLEHLEHQLETSLKQIRSTKTQSMLDQLCDLQNKEKMWIEANKALERKLDEIYRENQLQSSWGGGGGEQGNSSFNHHHHHPHSQAFFHPFDCNPTLQIGYPEVSNQMGTAATHEQNMNGLVPEWML

SEQ ID NO: 5796 - protein, 845 aa, Oryza sativa Japonica Group
MAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPGEGPSARRSPRLTPARTAASLYSAATLMSASLPWYDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKHMKFFLLVVDMLKFSFCKFLAKSQFYPLCGMVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGSVKRDDTRDGGSTPESCLY

SEQ ID NO: 5797 - protein, 113 aa, Physcomitrella patens subsp. patens
YCECFAARLFCVGSCACRNCFNKPEYEATVLNTRQQIEARDPLAFAPKIVQAAEPTPIPRDDALDTPASARHKRGCNCKKSLCLKKYCECYQAGVGCSEGCRCEGCKNMYGRK

SEQ ID NO: 5798 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYSEMLTKYHEEL

SEQ ID NO: 5799 - protein, 488 aa, Physcomitrella patens
MNRDMVGIVSSASARLEENPRLESYIASTGELAGWVEKSASVEATRSSLQLSQSQAFFEQYSTQYPQSDISSSSQADISAHDYLNIFKGTHAQAKADMKPRITQFMIPVQNQLEAGSYLLPHMAHDDSNNFSTSSNIGRATQSLCTMHQDMETLRQVPKSNDLLIAITASAAAAVNQERGSGSETGQHDRDDDEKNKATDRGKLPENEEEQLLRDAIVDHPLYPELVVAHISIFKIGAPKGLLIKLDEMEKKFQRFQYGESSWNVLHVTKFGQDPSLDFFMRSYIDLLTKFREDLENPYNKFAQYKDKVTKDLEDLCGHYIETTPDEEDNFGSDIGTKDMSQDLNDLEILGEENLMYTADIDESIVIDPDAADEELKKMLRLKYGKHIAGLKAEFNRVRKKGKLPTNARQILKDWFSRHSYWPYPSEMEKAYLQRLCGLNLKQINNWFINERKRHWSCKGKCMYPNTKFYPRDGHVDPNNHGEGYLEQ

SEQ ID NO: 5800 - protein, 225 aa, Populus trichocarpa x Populus deltoides
MASETELPAELSSMFERLLRHRDLSLFLPFIFGFTSTNSTEERDPDQEPQTTDPNERIILINPLTQGMVVIEGAASLESLLRDMGNKNGQPPASKASIEAMPSVEIGEDNKDGECAICLEEWEPGAVVKEMPCKHRFHGNCVEKWLKIHGNCPVCRYKMPVDEEELGKKRDGGDGGREWRRAEREIWVSFAFNGNRRNRDSNENPSSDSTDFSTSSPSADHETES

SEQ ID NO: 5801 - protein, 266 aa, Zea luxurians
PSADPSTDSAREPKRMRTGGGSTSSSSSSSSSMDGGRTRSSVVEAAPPAKQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGD

SEQ ID NO: 5802 - protein, 165 aa, Stauracanthus genistoides
SSSSYHPFPFINPENASANNNTFPHDPLSVSYNIPPTHHHAPIPETIANFADCAAAAAMFKNDVNASNFGFSNFLTKKPAPKKDRHSKIHTSQGLRDRRVRLSIEISRKFFDLQDMLGFDKASNTLEWLFNKSKKAMKELAQSKNSSSSVANSFSSSDSECEMVQ

SEQ ID NO: 5803 - protein, 133 aa, Glycine max
KSNVTEEEKAREVVHVRARRGQATDSHSLAERVRRGKINEKLRCLQNIVPGCYKTMGMAVMLDEIINYVQSLQHQVEFLSLKLTAASTFYDFNSETDALETMQRARASEAKELGKYKKEGYGGVSFFQPAWPL

SEQ ID NO: 5804 - protein, 231 aa, Oryza sativa Indica Group
MAVSLIGFDSACVCLIRPAAAATATATAKKGQKRARQPRFAFMTKSEIDHLEDGYRWRKYGQKAVKNSPFPRSYYRCTNSKCTVKKRVERSSDDPSVVITTYEGQHCHHTASFQRGVGGAAVAAHIHGAAAVALAEQMSAFVSPPPQPHMLYGLPRLHPPSSETAVSCSMPTTTSLQELNNSEGLQRPGYNNSPQAAVTIAQRPPSPSVPPAVSFDKGLLDDIVPPGVRLG

SEQ ID NO: 5805 - protein, 190 aa, Pterospartum tridentatum
SSGPYPYPYFPSSSSLYHPFPFFNPENASANNNTCPHDPLSVSYNIPNTLHHAPIPETLANFADCAAAAAMLKNDVNGSNFGFSNLLTRKPAPKKDRHSKIHTSQGLRDRRVRLSIEIARKFFDLQDMLGFDKASNTLEWLFNKSKKAMKELAQSKNSSSGVANSFSPSDSECEVVSIINQDSIDSTPEG

SEQ ID NO: 5806 - protein, 365 aa, Zea mays
MGAMAEVVQEGCVENRQPLAASSSSVSDGSSCGGGGRAGTSPPVSSSGNSISVLRRTTGPIRRAKGGWTPEEDETLQKAVVAFKGRNWKKIAEFFQDRTEVQCLHRWQKVLNPELIKGPWTQEEDEKIIDLVGKYGPTKWSIIAKSLPGRIGKQCRERWHNHLNPEIRKDAWTPEEERALIDAPSVFGNKWAEIAKALPGKVLIHCLLLHQFSLYKITYASRPCEGRTDNSIKNHWNSSLKKKLEAYSNSSVLSVSKLFVHDDFKDKMKPVATDGHLDLNQMPSIGSKDSSGRAYHSIVSPLSQAYNLDSSCLSLSIPTMQPLTSHEMSSLIDGSAVTLVVQCLESDSVRDKDQEIDSVQEKGVE

SEQ ID NO: 5807 - protein, 157 aa, Daucus carota
NQQGRLSQEQSYRGVRKRKWGKWVSEIREPGKKARIWLGSYEAPEMAAAAYDVAALHLRGSAAHLNFPELVGSLPKPVGSSHADVQRAAQEAAMGFGKSENRGPVTVQLSSSEIRAINESPLDSPKMWMEMGGSVFLEERRDEEQLEEMQCSSLWKF

SEQ ID NO: 5808 - protein, 227 aa, Oryza sativa Indica Group
MAASEQSSESSSTASTSSCGKKQQVAGKRKREDVGGGGEQAAAVSYRGVRMRAWGKWVSEIREPRKKSRIWLGTFPCPEMAARAHDVAALSIKGARAVLNFPDLAPALPRPGSLAPRDVQAAAALAAVMHHHKHPSSSTSTSSPPAAPPPDEHHPRHEPQQPESSREDDQQQQPPAAAAAQMAVAELVFDELAPLWVEDVEFGTSDHCWTAYDALDPIGFQPLLWEY

SEQ ID NO: 5809 - protein, 1338 aa, Zea mays
MALRTVLVSDVPSLPDSVYGLSEGLELSKPTSFRLPGFSVIGHRGIGMNVTKDDCPVIFHDDFIYSEENGIVNESRVTDLSLSEFLLYGPQKETEKIGKTLMRKSKEGKVLKWDVDLDDSLCTLQEAFEQVEQTLGFNIELKFDDQTVYEREFLVHILRSVLQKALGLPMKALTVPDECNDIFSTHPRDLPGYGSEEHWYFYCKKPKNQVTRTKSYNLWIPTGEKTDVLDPKKNGGELVGIKHSFTFIENEEEEESDNKNGDEEEPPQCNWFLDEISLPLTVVDTDWTLCHIFYEKVKPEFVLSGDMMKASFGRLRRFALPKADAIDIGELFPTAQIEGLARAAKDMQDMREGYDRLLEVAAAMANSAYEFSESLGEMGSCLEQIAPHNDQESGGILLMLGKVQFELKKLVDTYRSQIFKTITRPSESLLSDLRTVEDMKQQCEEKRDVVKHMLMEHVKDKVQVKGTKGERLIRRQLETARDELQDEATLCIFRLKSLKEGQARSLLTQAARHHTAQMHMFFAGLKSLEAVEQHVRIAADRQHIDCVLSDPGNEMDCSEDNDDDDRLVNRDGELSFDYITSEQRVEVISTPHGSMKVNADPREEHSVSNRDRRTSSHSAPLFPDKKADLADRSMRQMTPSANAYILPTPVDSKSSPIFTKPVTQTNHSANLWHSSPLEPIKTAHKDAESNLYSRLPRPSEHAFSGPLKPSSTRLPVPVAVQAQSSSPRISPTASPPLASSPRINELHELPRPPDGINRGNEGSFRFSIGESDRKTAVESLEFRDDLWRFHDTRSVTSLPAHEPTYAMDKVNLSRTEVRRIVGFESNEVSSVSNEYTSITVNRTGGSNEVDIIGGSLVRKRVSSPLNKLFPEKFRGDSLDISHSNQPMTSAGLPKGFHIPVGQDHKKANISGRLRLFTTSNCSEWGNDTSHTGKLSSTVFTDGPLLDSNDLQPSQDVHCLYSPVHETFQVPNKPLPCHRNISVSPPLSLSPLGPRFSERMKALQGGLNGNIFEDDVCLKNTGEEAELRTGHRSFDDTNGIQRAFSMDRAIESVPTSPCKRFSRSLSGRPIQRSLVGSFEESLFSGRLSYGQANQKIDGFLAILSIAGGNISPKSQKLPFSVTSVGDDCFLLYYASIDLSGGSLPSKLWGQKLKTNQNKSDAQTINKRLRIPMKGRIQLVLSNPEKTPLHTFLCNYDLTDMPHGTKTFLRQKVTLASSVPTKAKKSANKGSEGSELVDELHSPNECGNKNCRETYRETGQRCSKSGVLRYALHLKFICPLRKKASKLGQKKSLDAGDDGERRFYLYNELRVVFPQRHTDSDEGKLNVEYHYPENPRYFDV

SEQ ID NO: 5810 - protein, 578 aa, Arabidopsis thaliana
MVSRKCVEEFGYASYLVPSNARAPRSARKRRSIEKRISKEDDNMCAIDLLATVAGHLPFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 5811 - protein, 247 aa, Oryza sativa Indica Group
MSGTPADGGGGGSGDDWFLDCGILEDLPAAACGAFPWDASPSCSNPSVEVSSYVNTTSYVLKEPGSNKRVRSGSCGRPTSKASREKIRRDKMNDRFLELGTTLEPGKPVKSDKAAILSDATRMVIQLRAEAKQLKDTNESLEDKIKELKAEKDELRDEKQKLKVEKETLEQQVKILTATPAYMPHPTLMPAPYPQAPLAPFHHAQGQAAGQKLMMPFVGYPGYPMWQFMPPSEVDTSKDSEACPPVA

SEQ ID NO: 5812 - protein, 219 aa, Daucus carota
AESDGSGISAGKKLSAQTPSSVNKKMKKFKGVRMRSWGSWVSEIRAPNQKTRIWLGSYSTAEAAARAYDAALICLKGPSANLNFPAFSQQHFTPYINDQITSMSPKAIQRIAAQAANTFLDNATALPSPPPLSSASSASSSPSNNVEDDVSLAFEDHYKPDETVMNVNAPWMFNNDFGSFKFRDMIDDMLLFDDQQPAMMINHDHVYEGEEDLRLWDFC

SEQ ID NO: 5813 - protein, 1066 aa, Chlamydomonas reinhardtii
MAAATAGFAPSGPGHLHPALSAPMPLSALATGLSGGSGSGRPAIAAAACSTGSGVGGGSGNATGSHVNRARLLQILNLATKQQQQQQQQQQLQAGAAAGRGTMTPARYRESLQRLQSRRHQLLAQQQEITRQLLAIEEEEAALKAGMEEAAMAELGAAGAGLGLLGGGLGLGLGMGVAGGRPGLGVDEDGEGGGGSGEAAEPAEGEEEQLGRGGAGVGAGVLPSWAAAAAAQLHLHAALGTPQRSAAPQRPPAAATALAPHSQPKPQSQARPQSQPRPQHRPQQAARQQAAEPPLASVPAGPLAPRQQQQPPADLVPPGLAAWPNSRLLVADGGVAEDCGAQTAAGMDTGTPGTEVPGAAAEAEAEAEAEMAAGLALRQGGAAAAQALADMKAEGPAGDAPAGPAGPLGADGAAAGGGGVLSLDAHRGSSGSSGSGAAAGALRPLLQSPSRLQLELELGGALRQQGQLKQEHGQEQPQQQQPHLQQPPPPPPPQQQQQQQQQQQQQQQQQQQHVQQPVLEAGASERRARPPGRGGDLDPPPPAAAGNVEALLGSAAEPPAASLIRLQQLQQLQQLAALQALHPNQQPGLAAAAGAAAAAAAAAAAGVESGDATAEQQPQLLAQQSQLQQLHLLQHIAAQQQQQQQQQQQHQANSFRPQPQLQLQPSQSLPLHSAGGGGADGGAAEQMVSLLQRQLLLQQLQQQQQQQQAGLGSANNTSSVFDVDYSLTPAQARLAEAAAAAAAAAALTSGTGAGALTNGTGAAGTATMVRGGSTATGIGASGTVEVSGKRGALKPQPQQQMTVAGPAAVAAAAPSQPAQPRSQPSQPQTQSQPQPPQTQQQQVQTPRPPQPQTSQPQSGRGRKRSSSGRGAGGSGGSGGGGGGGSGGGEDDSDDDDDEDDDGFDGPDDEGEGLGGGGGGGSGATGRGLPADITLADLRKYFELPNQEAAKRLGVSGTHLKRKCRQLGVLRWPQRKLMSLRALAASIQSDARLNEESRQALLAQVARNHQSIMDDPNAPLAAGLKVTRQVQYKQTFDRRTKGSGPGCGGGGGGGGGGGGGESGSGGY

SEQ ID NO: 5814 - protein, 309 aa, Zea mays
  misc_feature (259)..(259): Xaa can be any naturally occurring amino acid
MFRCLAGWMRRVRRSVERSNRAGKLGRSVWGNRIAWMGFGIGREAGGCLFSPVPKLSVDDGDNRGRAKLIECLADVGLGGICWIANCSMWCTKNWTALGLGLGLGWDCFAFDCVYAYYVLIRCGFGRNFADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTVXSGTSYIIPSISVPTNQPRNVTVVVENPMPVDDKGKLVSNVVVGVTSGGKK

SEQ ID NO: 5815 - protein, 315 aa, Glycine max
  misc_feature (270)..(270): Xaa can be any naturally occurring amino acid
LHKAWEFFLPLDCPDHNHFLNSLSLLLHQACRSTFHLSLIHDHHLDFEFLPTESPSQASWIAHMMEAQSQHIKGVCLSLEEEPKEEFKVTTTHYCNWDSTATSTYQAHDQVVFGEESHTHTFGGKRGRKPGEKRRTKAEKTISLPVLRQYFAGSLKDAAKSIGVCPTTLKRICRQHGITRWPSRKIKKVGHSLKKLQLVIDSVQGAEGAIQIGSFYNSFPELSSQSSKSNNNNNSSSPTAAAAAAQSPQQPLRVKATFADEKIRFSLQPXWGFTELQLEIARRFNLNDVSNGYLVLKYLDDDGEWVVLACDGDLE

SEQ ID NO: 5816 - protein, 215 aa, Triticum aestivum
YVVLQLEKEEILAPHTHFCVICGKGFKRDANLRMHMRGHGDEYKTPAALAKPMRDSGSDPTPVTRYSCPYVGCKRNKEHRKFQPLKTILCVKNHYKRSHCDKRYTCSRCNTKKFSVIADLKTHEKHCGRDKWLCSCGTTFSRKDKLFGHVALFQGHTPALPMDDIKASGALEQPQGSEAMDDMVASTGYNFPGSTSDGIPNLDMKVADDGVDRYV

SEQ ID NO: 5817 - protein, 193 aa, Griffithsia japonica
LGMVVRKVKGPWRPEEDAILTQLVAKLGPRRWTVIASHIPGRTGKQARERWLNQLSPDLAKRPWTPEEDRVVMQAHARLGNRWSEIAKLLKGRTDNATKNRFNTTIRRQISELAAGNARADSVGGASSVVDSGAPTEMGVASAGEGGGGLVEASVMGLSCDGDDRRNAKRKRDGSHSSHEPMSQRTKTLTAST

SEQ ID NO: 5818 - protein, 114 aa, Scaevola aemula
HTAQGFRDRRMRLSLEIARKFFDLQDLLGFDKASKTIEWLFCKSNKAIKEVMESSNSQYTNQSMSEEIKWSISPLSECEVESTMENTATTNKGGNLRGQSRKRMQSNPLARETR

SEQ ID NO: 5819 - protein, 273 aa, Solanum lycopersicum
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 5820 - protein, 257 aa, Medicago sativa
MEGMAQHPVPRTVEEVFSDYKGRRAGLIKALTTDVEKFYQLVDPEKENLCLYGFPNETWEVNLPVEEVPPELPEPALGINFARDGMQEKDWLSLVAVHSDSWLLAVAFYFGARFGFGKNDRKRLFQMINDLPTVFELATGTAKQSKDQLTAHNNGSNSKYKSSGKSRQSESQTKGVKMSAPVKEEVDSGEEEEEDDDEQGATCGACGDNYGTDEFWICCDMCEKWFHGKCVKITPAKAEHIKQYKCPGCSIKKPRIG

SEQ ID NO: 5821 - protein, 149 aa, Chlamydomonas reinhardtii
MDEDYDTANMHNYAAGSNVARWGRLEELDPGDEAFLKSLERKQQLRKPLRCQVGGCTADLTDVKKYFQRYRICERHLKAPSLKMDGRAVRFCDQCSKFHDIGAFDGARRTCTEKLEKTRQARVALNGGGGGGSMSLDLERRAAGPQRRQ

SEQ ID NO: 5822 - protein, 58 aa, Hordeum marinum
KGKLPKEARQKLLHWWELHSKSPYPSETEKMALGESTGLDQKQINNWFINQRKRHCKP

SEQ ID NO: 5823 - protein, 208 aa, Zea mays
MASTSSSTPAPVEVDERGRKRKRAAGADPAAPAQPSKWRTRREHEIYSSKLLEAIRLVRAGPPSAAAAGTAAAPPRSRAVREAADRALAVAARGRTHWSRAILASRRRRLQAAHRARLRAPASPPARHGAPSASAAKGAATPPLERKAKVLGRLVPGCRKLSFPTLLAETTDYIAALQMQVRAMTALAEALSAVSATSSSGAGSSSPP

SEQ ID NO: 5824 - protein, 296 aa, Populus trichocarpa x Populus deltoides
MSFTGAPPLPAVTAAATTTSKQYFCYQCNRTVSITPSSYDDPFCPICHDSFIEEFETQNPQNPNPFSDSYFNDPFDPFSSLFPLLFQNSGNFSHPEFPTRPGFSDPNAFNPLEFLRSHLQNLHSGGGRVQFVIDNNGHEPGLRFPDGNFGDYFIGSGLEQLIQQLAENDPNRYGTPPASKKAIEALPTMKVTEEMMKSEMNNQCAVCKDEFEGGEEVKGMPCKHVFHEDCIIPWLNMHNSCPVCRYELPTDDPDYENRSPGGQGSGGGSAGGMERRFTISIPRAFGGSGGGGQSSS

SEQ ID NO: 5825 - protein, 57 aa, Pennisetum glaucum
KGKLPKDARLSLMNWWNTHYSWPYPTEEDKRRGRHDGLDQRQINNWFVNQRKRHWKP

SEQ ID NO: 5826 - protein, 195 aa, Oryza sativa Japonica Group
MEQADESSVNKESSEQQQLTSEQDDDGATWLSLTLATQGSPEEATAEAEETEAANCSESEAPKPSSAPHKVFSCNFCMRKFFSSQALGGHQNAHKRERSAAKRSYHAQRMMMGLPLEAHAAFVHSLRVNQSSVIQKASQQAQIRTAPRFHEGSISWPPIAYEEVPNSTWPGSFRLRSQPSDQPSEQSKIDLNLRL

SEQ ID NO: 5827 - protein, 212 aa, Zea mays
MRRRGVAAADADGDVELRFRGVRKRPWGRYAAEIRDPAKKARVWLGTFDSAEDAARAYDAAARMLRGPKARTNFPLPAAAALHHPHMPAAAAAAAPPYTTYPTATGVVSTPPVARPACSSLSSTVESFSGARPRPVLPPRFPPPSIPDGDCRSDCGSSASVVDDDCTDAAASASCPFPLPFDLNLPPGSGGGAGVGFYADEEDELRLTALRL

SEQ ID NO: 5828 - protein, 281 aa, Triticum aestivum
MATTVDWRSYRPDLPAAMYRMVDSRDQVMHAFAPPTAQGAAPTISFAFPCPGADQSAGLLRGATYLTPAQILQLQSQLHHVRRAPGAPMAAVGQPMKRHGVAALPARPATKLYRGVRQRHWGKWVAEIRLPRNRTRLWLGTFDTADEAALAYDAAAFRLRGESARLNFPELRRGGEHHGPPLDAAIDAKLRSICHGEDMPQSQSNETPAPTPTLTPISFPDVKSEPVCSVSESSSSADGEVSSCSDVVPEMQLLDFSEAPWDESLLRKYPSLEIDWDAILP

SEQ ID NO: 5829 - protein, 285 aa, Oryza sativa Japonica Group
MAVSMSFIRFQSDSLEATSKCQTRHTHTEQQQQQQQHQTARHNERSLAFQAIKRFDMVKTAASNGAAAARRVGGGGDGKRAAYKGVRMRSWGSWVSEIRAPSQKTRIWLGSYSTAEAAARAYDAALLCLKGSAAADLNFPVRLPFDLPAAAMSPKSIQRVAAAAAANANANASSSCSAAVFAGVDDSGGASASEASTPACSSSDGAASPSPVSSPETVISDVDVDYSLLADIEAFFQSPKCMEYAMMDPCSAFFAPPPPPAMAMEEECGWEEEGDIALWSFSSLD

SEQ ID NO: 5830 - protein, 261 aa, Zea mays
  misc_feature (62)..(62): Xaa can be any naturally occurring amino acid
  misc_feature (187)..(187): Xaa can be any naturally occurring amino acid
MGRGKVQLKRIENKINRQVTFSKRRSGLLKKAHEISVLCDAEVALIIFSTKGKLYEYSTDSXIHGISEPCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKEKALLLHAXLAEKQKDQRQQVQRDQTQQQTSSSSTSFMLREAAPTTNVSIFPVAAGGRVVEGAAAQPQARVGLPPWMLSHLSC

SEQ ID NO: 5831 - protein, 207 aa, Herrania albiflora
KKVERSLDGQITEIIYKGAHNHPKPLPCRRPSVGSTLSSDEMSEIAEGGGTSVKVEGGLIWRNAQAGSRDIKLGSDWRADGLERTSSTSVVTDLSDPLSTAQGKSVGAFESAETPEFSSTLASHDDDNDDRATQGSISLCDDAANDDEYESKRRKTESCLTDMNAASGALREPRVVVQIESDVDILDDGYRWRKYGQKVVKGNPNPR

SEQ ID NO: 5832 - protein, 234 aa, Lycopodium annotinum
MGRGKIEIKRIENSTSRQVTFSKRRGGLLKKAHELAVLCDAQVALIIFSNTGKLFEYASTSMKEILDRYRKYPDGIQTGRVMEYDNDVMVQHWSREVMRMKQQIERSYQTQRHMMGEDLGLLPLKELQHLEQQLDTGLNRVRARKDQVLREQIDSLRIKELQWHEENEILRRKIAGAHGMTEVAVRSFSSQNIVNPLETREPPSIGQVSVPFSLHVNQKNLRENQNLQTSLQLG

SEQ ID NO: 5833 - protein, 207 aa, Herrania cuatrecasana
KKVERSLDGQITEIIYKGGHNHPKPLPCRRPSIGSTLSSDEMSEIAEGGGTSVKVEGGLIWRNAQAGSRDIKLGSDWRADGLERTSSTSVVTDLSDPLSTAQGKSVGAFESAETPEFSSTLASHDDDNDDRATQGSISLCDDAANDDESESKRRKTESCLTDMNAASGALREPRVVVQIESDVDILDDGYRWRKYGQKVVKGNPNPR

SEQ ID NO: 5834 - protein, 207 aa, Herrania nitida
  misc_feature (14)..(14): Xaa can be any naturally occurring amino acid
  misc_feature (127)..(127): Xaa can be any naturally occurring amino acid
KKVERSLDGQITEXIYKGGHNHPKPLPCRRPSIGSTFSSDEMSEIAEGGGTSVKVEGGLIWRNAQAGSRDIKLGSDWRADGLERTSSTSVVTDLSDPLSTAQGKSVGAFESAETPEFSSTLASHDDXNDDRATQGSISLCDDAANDDESESKRRKTESCLTDMNAASGALREPRVVVQIESDVDILDDGYRWRKYGQKVVKGNPNPR

SEQ ID NO: 5835 - protein, 294 aa, Brassica napus
MQEAALGMIGATVGGGGDGDAAVVAEQNRQMKGEIATHPMYDQLLAAHVACLRVATPIDQLPIIEAQLSHSHHLLRSYASTAVGFSHHDRQELDNFLAQYVMVLCSFKEQLQQHVRVHAVEAVMACREIENNLHSLTGATLGEGSGATMSEDEDDLQMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 5836 - protein, 738 aa, Gibberella zeae PH-1
MAGIVAVTWKFSSEREQWAHRPEPGQWYASRHWSKQLKQWDAEDHEDNLELKTIIWGSLMFCGETETLIPFLNPRASDKCWKRILEMNRSIRQSSESFESCLPSQSIHGLTSDLVPPASIKFQEPKPQLLASRAFRLAGLAVGLGLSALTAYQRNQAQQMSSHAERHGHLDATAGREVVYCHACANEWYRDEDGLTCPECRGEITEIIDPENDPRDLDHHSSASTSPELHPYDSDPDEADIDEHTNQGFVFRRNIREGSGHHHHHDPAYAPTIESFVNMLNQFGARTPDGRSFSHGPGEHGEHQGHGEHERQGHEGQAGEGEHAHPNFARVQRATFTGPFGSGRTTITMISTPMHTTHTVPPGAPGLQTFQEYAQSLSRRPDGPRGLRVTAISLTMGANQPSSIFSDLLRDTGPPPGHEHVGEDGMGGGPPPGFGRGLQDLLNLLTPGNAVHGDAVYSQEALDRIITRLMEANPQSNAAPPATDEALRNLERKPVNKQMLGSEGKAECTICIDEMKEGDMATFLPCSHWFHEECVTLWLKEHNTCPICRTPIEKNDRGASNNSGNNNSSGSNQSQGPASGPSSDRSNPFAAHMPNAYNTDWEPFDWTSQPHSHSRPAQYSRPPSQSQSRLNEVLRNISTQREERDREHGRDRATTSGYSYDTSRLQRRSSHSPTSPRARAPSEHGARMRQRSPSQSSRRSTADSDQQSRTSGHGPISWLRGQFSRGPGTGSPRDGSRQ

SEQ ID NO: 5837 - protein, 543 aa, Vitis vinifera
  misc_feature (86)..(86): Xaa can be any naturally occurring amino acid
MNEGKASSRYVCGDASRASVSKHNFRHRIKQAEYEKAGDRTNERHVSEQSFDDQSGGSRSNTFLSAGNLISLDAGTHSLTAAELKXQFSCRDDLAPKARKPYTITKQRERWTEEEHKKFLEALKLYGRAWRRIEEHVGTKTAVQIRSHAQKFFSKVVRETSGGNTNSAEPIEIPPPRPKRKPVHPYPRKLVHPLRKGISVLEPPVRSVSPNFSASEQENQSPTSVLSAVGSETLGSTLSNTQNGSPSPVSSAAGVNPDRMFLPELNPPTEENASPSPVLTTSSSVPDEPLPMKFELFPQEIFAKECSVEEASTRTLKLFGRTVLVTDSHRPSSPTTSKSQPSDINNEGMHVETLPWNSTPTESSPENSSFSWSHLQPQPSGAFYYMHFQKEDSNCVEAGTTAPLPWWTFYGGIPIPFLPLHHQDSIKAHEDTKFAETHDKEIQKEGSWTGSNTGSVNEGGNCDTNWDVETQSHQPYLDTMEKESDSAFELKLSERSAFSRGRTNTDKCVKGFMPYKRCLAERDTQSSIIIGNEREEQRIRLCL

SEQ ID NO: 5838 - protein, 205 aa, Glycine max
MTRKRIQIKKIDNISSRQVTFSKRRKGLFKKAQELSTLCDADIALIVFSATSKLFEYASSSMHQVIERRDSHSAMNRLDRPSIELQIENDSNEILRKKVEDKNRELRQMNGEDLQGLTLQELHKLEEHLKRGLINVSKVKDEKLMQEISTLKRKGVELMEENQRLKQVVPSLIHVHRQSSESILSNSSNLPEDGGSDTSLKLGLP

SEQ ID NO: 5839 - protein, 222 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 5840 - protein, 431 aa, Daucus carota
MFGSEQEESSPQNIINMHFDHQHHQTTITSPSVHMRQLLISCAEHISRCDFYGAHRLINILSANSSPCGDSTERLVHQFSKALSLRLHSFAATSTITSGSTSNLVIPSLLTPKISPALPSSAGSGSGSQQVFDDESVVQSAYLSLNQITPFIRFTHLTANQAILESVEGHHAIHILDFNIMHGVQWPPLMQAMAEKFPPPMLRITGTGDNLTILRRTGDRLAKFAHTLGLRFQFHPVLLLENEESSITSFFASFAAYLQPDQTLAVNCVLYLHRLSLERLSLCLHQIKALNPRVLTLSEREANHNLPIFLQRFVEALDHYTALFDSLEATLPPNSRQRIEVEQIWFGREIADIIASEGETRRERHERFRAWELMLRGSGFHNLALSPFALSQAKLLLRLYYPSEGYKLHILNDSFFWGWQNQHLFSVSSWH

SEQ ID NO: 5841 - protein, 58 aa, Oryza officinalis
KGKLPKDARQQLLNWWELHYKWPYPSESQKVALAESTGLDLKQINNWFINQRKRHWKP

SEQ ID NO: 5842 - protein, 300 aa, Zea mays
MEDLYSIHPGISRHGAAAASEASGVAGGPGSPPPPPPPAADLTELVKAQIAGHPRYPSLLSAYIDCRKVGAPSEVATLLEEIGRERCAAASAGGEVVGMDPELDEFMETYCRLLERYKEELSRPLDEAASFLSNVRTQLSSLCGGAASLSDENEMVESSENEPCSGDTDATTDPGQEHSSRLADRELKEMLLKKYSGCLSRLRSEFLKKRKKGKLPKDARSALMDWWNTHYRWPYPTEEDKVRLAAMTGLDPKQINNWFINQRKRHWKPSEDMRFALMEGGVAGSSSGTTLYFDTGTIGP

SEQ ID NO: 5843 - protein, 387 aa, Oryza sativa Japonica Group
MDMMEEEAANAATAQAAAAGDLADVVARANARAFLVSTPHHHPSPLHPLPPPPMPQAPHQYYPAPQITIPYHHHHHGELRRPTTIAYTDAPVPFETAGPPSTVVDSYHHLTPGDAGYGMPRPLALQISQHALCGGGDVVMGGGGAGAADDGEEAIRISPLTPSAHHQMMKRKNEVKKVVCIPAPPATSSRGGGGEVIPSDLWAWRKYGQKPIKGSPYPRGYYRCSSSKGCMARKQVERSRSDPNMLVITYAAEHNHPWPMQRNVLAGYARSHHSTHATASSSRHKQQQQQQTNQLQPALITSSSSSSSSPFNLYADVVLGGQQANMMMTTEGAGAGLGIQPSAADEVFAELEELEPDNPTMINANMQVYSTTSRPGVSSYDHQWHKF

SEQ ID NO: 5844 - protein, 780 aa, Oryza sativa Indica Group
MSIKICPGEYDANITREEVVWSRRVLAAKDGTIWARLFMVDREGCWSLSSILRQWLGSETNKEGARGGGRFEVVATTCEVTIVVGCMKEMSAGQFYCKGEERVDGGAGVKRRGAPQRKGKSPKKVEGKTYKYKGFVIEGCELDSTIIMIKSSDLVHIPSIFTPPEVNSQKGSKTSICIDRSLSQAYHDSPDNASILPTNLAQRIQLSSDTLGSDKRHGIAGKTDHETAQKHAKLSCFDQRCLDKMKQLTSGMNVQKRDLAKTHNDEITACDWDYLGTQYDSSVVPESDLRFETAELLLETPKNGDAMPGKSFLPIVEANLENSRRKLFQGSADCYSQSAVDNIHAYCTSRGKEVATNHVSGILPCPRESQLIPDHHFSDSLEVPSDYMAMNPSAVSQHLRGLHRRSLFNDKVRDPTMGVQSVSNLGASTCATRHRSIPDDNYSKLVGSPVCALPNVDLHLVRMTEEMLAPNTSEMNTHNQGDYSSQATMPTSAGNSGQENPKRKRQKCQNDNVDSCKRCSCKKSKCLKLYCECFASKVYCSESCSCRGCFNDHSHEETVLSTRNRIESRNPLAFAPKVIRTCGPGLEFGSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 5845 - protein, 201 aa, Physcomitrella patens subsp. patens
TNTFISNELGGVSGGLENLDTESRSDDDSDGDGDGENIIPGSFDLVEMNASEILAEHTHFCEICGKGFKRDANLRMHMRGHGDEYKTPAALARPDKDYPDTSATRLRRYSCPCVGCKRNKEHRKFQPLKTMLCVKNHYRRSHCPKVLTCQKCMTKKFSVVADLKTHEKHCGRERWQCSCGTTFSRKDKLFGHINLFAGHTP

SEQ ID NO: 5846 - protein, 221 aa, Glycine max
GTFIELKLAKTVRPAYGKTIPVQKVSLKGKDLLQFQTNSPVSVFESSSSSPSVENSNFELPVIPTKRPRTKRRRLSNISLLYSIPFILTSPAFQKFQRMDFSKSDIQTQPSGELLCKFKKKQRKKDIPLPTNKIEMKRSSSQESVAPRKCLHCEVTKTPQWREGPMGPKTLCNACGVRYRSGRLFAEYRPASSPTFVASLHSNSHKKVLEIRNRATQVTVR

SEQ ID NO: 5847 - protein, 172 aa, Glycine max
KMIHKEIERQRRQEMATFYASPRSLSPLEFIKGKRSISDHMNEAVNYIKHMQKHIKELGAKRDELKKLSNHSNNMENNHEGLHTSCNFTVHEKNGIMGIEITSVFREEKPKISKLLQFLTEEGLEVVSFFSTEVNGRLLHSVQCEVNHSNSVDPSELRKKVSKAFSTFRCSD

SEQ ID NO: 5848 - protein, 662 aa, Dianthus caryophyllus
MSFFENMGYYPNFEFPPQVTVVREEEPVAEVEQEGNDEDYSDDDVDVDELERRMWRDKMLLKRLKEQNKDRCREWIDNVKKRQSQEQARRKKMSRAQDGILKYMLKMMEVCKAQGFVYGIIPEKGKPVSGASDNLRAWWKDKVRFDRNGPAAIAKYQADHLVQGMDEDCTAMGSTPHTLQEFQDTTLGSLLSALMQHCDPPQRRFPLEKGHPPPWWPVGNEEWWPQLGIPNDQGPPPYKKPHDLKKAWKVSVLTAVIKHMSPDIEKIRKLVRQSKCLQDKMTAKESATWLAIINQEESLARKLFPDRCPPPAPGGGGSLVISDTSDYDVDGAGPDSSSDVEDCKPQNINVFNFREKFMGHPVNMITPAIKGEVVETGFDFPVKRKQPSSGSQTVIDQKVFLCENPQCPYNDPCLGFPDRILRHDHQLNCPFRSRGVEVTNTQTTLEKHPSSESTNFTSSFAQQEKFSLQSAMQSPATFNPCTGTVLETGDQLQQNMQRKTTDGRFVGQGSALYGNSTYLGQQSQFQIDNVGFFASHGGNGSQGMFVNGKNNNQVKQKPSLQMSNGFNGVFQSRQQMQAPMDGGFRGLSNMSGNIPQGTKTSAGHQVFSSGGMQQQQQLDQCRTFDSSFPMHLNDDITDFGFNSPFNIDFEPLLRPDNPIWNI

SEQ ID NO: 5849 - protein, 163 aa, Brassica napus
QPDSSGGTLTYEVRMILEDNQITYPYSCLCVFFLKGRFEILSLSGSFMPSDSDGTRSRTGGMTVSLASPDGRVVGGGVAGLLVAATPIQVVVGSFLAGTNQQDQNPRKQNHNFMSSPMPTTSNAADHGTIRPTSSSHQIGTWTPPLASDPRHKPSNDINITLT

SEQ ID NO: 5850 - protein, 207 aa, Herrania nycterodendron
  misc_feature (49)..(49): Xaa can be any naturally occurring amino acid
KKVERSLDGQITEIIYKGGHNHPKPLPCRRPSIGSTLSSDEMSEIAEGXGTSVKVEGGLIWRNAQAGSRDIKLGSDWRADGLERTSSTSVVTDLSDPLSTAQGKSVGAFESAETPEFSSTLASHDDDNDDRATQGSISLCDDAANDDESESKRRKTESCLTDMNAASGALREPRVVVQIESDVDILDDGYRWRKYGQKVVKGNPNPR

SEQ ID NO: 5851 - protein, 266 aa, Zea mays subsp. parviglumis
PSADPSTDSAREPKRMRTGGGSTSSSSSSSSSMDGGRTRSSVVEATPPATQASAAANGTAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGD

SEQ ID NO: 5852 - protein, 591 aa, Dianthus caryophyllus
MVMLFEEMGICGGEMRFFGEFQEGGGSGGPQFPRDGGPTVEELISDEEMDVEELERRMWRDKMRLKRLKDQSKVKEGVDVAKQRQSQEQARRKKMSRAQDGILKYMLKMMEVCKAQGFVYGIIPEKGKPVTGASDNLREWWKEKVRFDRNGPAAIAKYEADNLIFMNSNAGDSIRSSAHALQELQDTTLGSLLSALMQHCDPPQRRFPLEKGLPPPWWPMGNEEWWVELGLPNDYGPPPYKKPHDLKKAWKVSVLTAVIKHMSPDIAKIRKLVRQSKCLQDKMTAKETATWLTIINHEEGIARQLYPHLCPLLIGGSGGPSYVISDSGDYDVDGTVEEPIVEPQEQKGASSEVNNETQPVILQMPNQIKGEMMFSDGDFTRKRKAAASSEQVINEQFPIYTCGFSGCLHQQRGFGFSDRVSRDNHQLICRFRNNNCLQFGNIQTNTNQVKAANNFQHSYLGSEVGNPGNNSALPLINLQGVGIPDAGQKMIGELMSMYDVNNNSGSVNQNVVQQIGFRQNDQIQFQGRGLTQNSFGPTAIQMNQIGFNRSNRFEHNMQENALNSTLPSPFDLPFIDFMDDVQAGTSSAWYR

SEQ ID NO: 5853 - protein, 147 aa, Washingtonia robusta
  misc_feature (126)..(126): Xaa can be any naturally occurring amino acid
MEGRSGSGGGEDGSCLMGGFGEGSGGLSPLMIMPLMASRSILPPTPHMSNNALFLPPPASNASGEDYDNSVIKAKIMAHPQYPRLLSAYVNCQKVGAPLEVVARLEEACASSFMIGQASSSAAAGXGGSGGGEDPALDQFMEAYCEM

SEQ ID NO: 5854 - protein, 704 aa, Dianthus caryophyllus
MGLFENMGYCTNSEFPPAQTAFGVEERERECEECSDDDVDVEELEQRMWRDKMLLRRLKEQTKDKCATEVDCGKKHQSQEQARRKKMSRAQDGILKYMLKMMEVCNAQGFVYGIIPEKGKPVSGASDNLRAWWKEKVRFDRNGPAAIAKYQADHSVPGMDEDCSATGSTPHTLHELQDTTLGSLLSALMQHCDPPQRRFPLEKGIPPPWWPVGDEEWWPQLGIPNDQGPPPYKKPHDLKKAWKVSVLTAVIKHMFPDIAKIRKLVRQSKGLQDKMTAKESATWLAIINQEDSLARQLYPYRCPPPLPCGNGFLVVGDASDYDVDGVGPDLVSDIEECKPRSNNGFDFQVCSEGEKFTANPMNMITPAIKGEAVDASFDFPQKRKQPSSESQLANEKKVFICENSRCPYSGSRLGFPDRISRHNHQLNCPFRVNSTRRVDIGTFLNTIEKLPSLESSNLTSSVAPQSETPSTSTISASGLGIPEYGQKFIANLISVYDSNLQPNENFNLGTGIASETSDLMQKNMLLNMDGTTAGNFNDHKQTQLQPQSLNDRDFFTLEGMIGDNASRGMNNAGATESSNFRTVTGSAVASKAKNVIHSPTKNAASREQTSFINQGITQTAQDRMDYHFHGQAAKLGDNFSRGSNVSGFVYETDGTQQQQLDQCRTFNSSFVMPLNEDAADFGFNSPFNLDFESLLTPDSSVWNI

SEQ ID NO: 5855 - protein, 282 aa, Perilla frutescens var. crispa
GSWRSLPKLAGLLRCGKSCRLPWTNYLRPDIKRGPFSTEEEKLVIQLHGILGNRWAAIASQLPGRTDNEIKNLWNTHLKKRLLLMGIDPHTHEPSLTSNGLLTRPPSSPSTRHMAQWESPRLDAEARLSKESLLSIHAPLPKSEADHFLRLSNSEVGETFRKIKNGEKAEPPSPSQSPGSSASTKCCSFSGTTTEIGLQSGLHETDCKSSKTCTEYVRTGTDSSSSNEMEDSSESTLQLLLDFPCKNDMSFLGNADCYSLYPGFTNGSLYDSSSQEKKGGFV

SEQ ID NO: 5856 - protein, 207 aa, Theobroma angustifolium
KKVERSLDGQITEIIYKGAHNHPKPLPCRRPSIGSTLSSDEMSEIAEGGGTCVKVEGGLIWRNAQAGSRDIKLGSDWRADGLERTSSASVVTDLSDPLSTAQWKSVGAFESAETPEFSSTLASHGDDNDDRATQGSISLCDDAANDDESESKRRKTESCLTEMNAASGALREPRVVVQIESDVDILDDGYRWRKYGQKVVKGNPNPR

SEQ ID NO: 5857 - protein, 431 aa, Oryza sativa
MQKKIRQSQPPKCKKLLLRKPIQIVSKHTKHVVPSGKGKRPPLKKENESDSEAGANTDDRIASPGRNRERSPRLHSDSDNSAAATAEAAEAAAAAALDDGDDEGNATPPPRSRRSSRVEATGVKPISSRPMDASRRPDAASSQSQRRSKRPRSSPTQHSPEQHKRPPRVWNPQDEVTILRALISYRAKNGALPGSSQDTGKLHNMIRGQLSVKASTTQLSDKVRRLKHKYNLILTRVTKSGRDPDLPTEHDREVYELSKKVWGTKSGGAGAGSGGGGGGGGGRVYENAEVVQSDEEQGSRDDSDEDMESGWDDRDHRNRRLKAIVVANGNGNAVTGGRSVHGNGSGKGDVADKGKDMYPYLWEAVEELSKEHPSGTAFRKAFGVLDGSRARAMEEKLNRFRLSEIRQQLRRMDLMKETIKMVLDALEGSDL

SEQ ID NO: 5858 - protein, 132 aa, Arabidopsis lyrata
MDQGGRSGGGGGGGGAEQMKYRGVRRRPWGKYAAEIRDSRKHGERVWLGTFDTAEDAARAYDRAAYSMRGKAAILNFPHEYSMGTGSSSTAASSSSSSRQVFEFEYLDDSVLDELLEYGENYNKTHNINTGK

SEQ ID NO: 5859 - protein, 601 aa, Prunus persica
MGMFEDMGFCGNLDFLSAPPGEGEAAPEHDPEATAEEDNSDKEMDVDELERRMWRDRMLLKRLKEQSKGKEGVDNARQRQSQEQARRKKMSRAQDGILKYMLKMMEVCKAQGFVYGIIPEKGKPVSGASDNLREWWKEKVRFDRNGPAAISKYQADHSIPGKNEDCSAVASTPHTLQELQDTTLGSLLSALMQHCDPPQRRFPLEKGVAPPWWPTGNEEWWPQLNLPKDQGPPPYKKPHDLKKAWKVSVLTAVIKHMSPDISKIRKLVRQSKCLQDKMTAKESATWLAIINQEEALARRLYPDRCPPPSAVGSGSFTISGTSDYDVEGVDDEQNVEVEDCKPLVNHFNIGTAGQRERMVPQIKGELIETNSDFGQKRKQLAEEPQMMLNQKIYTCEYPQCPYHDCRLGFLDITARNNHQLNCAYRGNSSQVFGMSGFHLNNDKPVGFSLPITQPKPAIQQPVNQTSSFNASGLGLAEDGQKMISQLMSFYDSNVQQNKNSNPGNLNVVEDHNQQQVKFQFPMEDNFYGQGLVIGRNMSEPTSLPMLHSVFPSTEIQFDPCKLFDSPYGNHPNDPVNLGFGTHLNSVDYNDDSMLKQDAFWI

SEQ ID NO: 5860 - protein, 142 aa, Oryza sativa Japonica Group
MDMDSSSSPVDKVDPDECNGSKACADCHTTKTPLWRGGPGGPKSLCNACGIRYRKRRRAALGLDSSATATATDGAEQQKKTKAKKEKAQEEEVTMELHTVGFRSKDAAVFKQRRRMRRRKCLGEEERAAILLMALSSGVIYA

SEQ ID NO: 5861 - protein, 499 aa, Oryza sativa
MYLYAAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKALPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASGMKISGSNTDRFHTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 5862 - protein, 395 aa, Zea mays
MDSASSLVDDTSSGGGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPSSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVAASTAGPSPRAPVAKAVRLFGVDLLTAPATAAAAPAEAVAVAGCKRARDLGSPPQAAFKKQLVELALV

SEQ ID NO: 5863 - protein, 607 aa, Vitis vinifera
MGCCYSRIEREEMVSRCKARKRYMKQFVKARQALSAAHSMYIRSLRGTGSALLQFATAETNLHYHHHHHHHHLTPIPPSPPPQQPSPPPPPPPMSPSSDTWTSITASPSHLPPPPPPPPPPPPPPAQSSWDFWDPFVPSSSRSVTEEEWEATTMASEAPATTAVSASVTAPPSVVSGFSKDTSSELAMVVSRNSKDLAEIVKEVDDYFLKAADAGSEVSLLLEIPRSTFSNQTGGKVYSCGKSSNPLWCPWASNSKLNGFGRLCEEMVVTDIAGGGIISGSSSHCSTVERLYAWEKKLFQEVKNAESIKIEHEKCVAQLRKLEVKRAADYVKTEKTKKEVEKLESRMMVASQAIETTSTEIIKLRESELYPQLLDIVKGSMSMWRSMYECHQVQMHIVQQLKYLNAIPSTEPTSEIHRQSTLQLELEFSKNPLSKTRQESMIYSLCEEWHLALDRVPDKVASEGIKSLLTVIHAIVVQQADEQKQKKRSESAFKDLEKKLVELRALECKQSPFSTPESSAITRSKDPIAEKRAKVATLRAKAEEEKSKHEKAVSVTRSVTLNNLQMGFPHVFQAVTGFASVCTHAFESVHNQAKCMDQELDVKRILP

SEQ ID NO: 5864 - protein, 250 aa, Solanum commersonii
  misc_feature (231)..(231): Xaa can be any naturally occurring amino acid
MGRGRVQLKRIENKINRQVTFSKRRSGLLKKAHEISVLCDAEVGLIVFSTKGKLFEYATDSCMERLLERYERYSFAEKQLVPTDHTSPGSWTLENAKLKARLEVLQRNEKLYVGEDLESLNMKELQNLEHQLASALKHIRSRKNQLMHESISVLQKQDRALQEQNNQLSKKVKEREKEVEQQNQWDQQNHEINSSTFVLPQQLDSPHLGEASQNTNVVDNGEVEGGNSSQXQGAANNTVMPQWMVRHLNG

SEQ ID NO: 5865 - protein, 329 aa, Oryza sativa Japonica Group
MGTMTLPPGFRFHPTDDELVGYYLKRKVDSLKIELEVIPVIDLYKFEPWELPEKSFLPKRDLEWFFFCPRDRKYPNGSRTNRATSTGYWKATGKDRKIACAGEVFGLRKTLVFYKGRAPGGERTDWVMHEYRLCQDLAHGVSNFIGAYALCRVIKRHEAGLHGEPPAAKAKGMISKVSSSSSLVTVEHQLSSRGNASPSFTPTNNGSPLVDEMFVGGGGGDPFQLLPSCVPYHGGDACGFDLPPLCMPQTQDPFFSDAGFTQAAPPLYGDVMGSVSEHELKWDTLGGYSGGGGGELWNAAAAPLLCRQASDGDDLTAWFTAADDNMSVF

SEQ ID NO: 5866 - protein, 223 aa, Capsella bursa-pastoris
MNSSSFSAFSEMFGSDYESPGSSGGGDYCPTLATSCPKKPAGRKKFRETRHPIYRGVRQRNSGKWVSELREPNKKTRIWLGTFQTAEMAARAHDVAAITLRGRSACLNFADSAWRLRIPESTCAKEIQKAAAEAALAFQDEMGDTTTAATTTTDHGLDKEETMVEATVTPEQSDSLYIDEEAMFGMPSFLDSMAEGMLLPPPSVQWNTNYDVDGDDDLSLWSY

SEQ ID NO: 5867 - protein, 263 aa, Zea mays subsp. parviglumis
PSADPSTDSAREPKRMRTGGGSTSSSSSSSSSMDGGRTRSSVVEAAPPATQAANGPAVPVVVVDTQEAGIRLVHALLACAEAVQQENFSAADALVKQIPVLASSQGGAMRKVAAYFGEALARRVYRLRPAPDGSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLRPEGG

SEQ ID NO: 5868 - protein, 621 aa, Phalaenopsis equestris
MGFPCGLDFSHFTPPSHDKNVTFMPIIQPPPPHPNFSHLPHPPCVDSAMIEGDLVDPLPDNFPEVIPDDEDSDEDIEVEELERRIWRYRLLVKQRKEQQNTKNRDFSDSVKHRQSQEQARRKKMSRAQDGILKYMLKMMEVCKAQGFVYGIIPEKGKPVSGASDNLRGWWKEKVRFDRNGPAAIAKYQVDNGIQSPNSELNSRFISPHSLQELQDTTLGSLLSALMQHCDPPQRRFPLEKGIPPPWWPTGKEDWWPQVGFSNDQPPPPYKKPHDLKKAWKVGVLTSVIKHLSPDIDKIRRLVRQSKCLQDKMTAKESATWLAVVKQEEDMFRDLHPDACPPPSSASNGTISFSSSCNEYDVEGVDDDDDDKCGEVMKNQDPIDMNNVFSMNNEEFIRKRAANCEPEMILNQGSVFNGETTKFRRNDYQSMKSNQLYQNSCYSTNPPPFITSSAFQPNENKPQIFSMSPMVVQQPKMASVNLQPAAAIATTPFSISGLGLPDDGQKLIAELLNQYDSNMNHGKVSGEVRAGNEVQKTDTFRLPNEAMSSFFGSKNGGGGSGIFEEANCSQLCSIHEELEQMDQVYQNQATDMSNDFRFGSSFSSPAMDFADSMSRGVGSWFF

SEQ ID NO: 5869 - protein, 153 aa, Oryza sativa Indica Group
MAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPSGSSYNAPPPTSAPTSRPQNVTVVVENPMTVDEKGKLVSNVVVGVTTGK

SEQ ID NO: 5870 - protein, 247 aa, Oryza sativa Japonica Group
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 5871 - protein, 444 aa, Vitis vinifera
  misc_feature (132)..(132): Xaa can be any naturally occurring amino acid
  misc_feature (164)..(164): Xaa can be any naturally occurring amino acid
  misc_feature (329)..(329): Xaa can be any naturally occurring amino acid
MASPSELSLDCKPHSYSLLLKSFGDQPDQTQKLEDFLARLEEERLKIEVFKRELPLCMQLLTDGDETKQQSTLTSSKEPDIGFTVSPKLGFDNKQRNGGAFLPFSKERNSCPSPNLRVLPDLALANSADHKXVEDKKCSETENGIAFSRRENCGKVVNGGATMXQVKAAITPSEAQTTAAAPTANTQTHRKARRCWSPDLHRRFVNALQMLGGSQVATPKQIRELMKVDGLTNDEVKSHLQVKSLSSSLVFFYFFDPHIKCVDMRETWQRLRTGLKLTKLWVRKYRLHTRRPSPSPQATGAAAPQLVVVGLGGIWVPPEYATAAHTGGXTLYGAHPPSHTSPHYCGPPVPQDFYAAPAQPHHHSLHHQLHMYKASPQTQSSPDSDMRGAGDRSESIEDGKSESSSWKGESGENGGERKGLVTLRDDGEESNRAMEVRLLSTSNF

SEQ ID NO: 5872 - protein, 231 aa, Brassica rapa
MINFEATELRLGLPGGNHGGDMAMKNNGKRGFSETVDLKLNLSSTALDSVSGVDLENMKEKVVKPPAKAQVVGWPPVRSFRKNVMSGQKPTAGDATEGTEKTSSSNGATSSAAAYVKVSMDGAPYLRKIDLKLYKTYQDLSDALSKMFSSFTLGNYGPQGMKDFMNESRLIDLLNGSDYVPTYEDKDGDWMLVGDVPWGMFVDSCKRIRIMKGSEAIGLAPRALEKCKNRS

SEQ ID NO: 5873 - protein, 207 aa, Theobroma bicolor
KKVERSLDGQITEIIYKGAHNHPKPLPCRRPSIGSTLSFDEMSEIAEGGGTCVKVEGGLIWRNAQAGSRDIKLGSDWRADGLERTSSTSVVTDLSDPLSTAQGKSVGAFESAETPEFSSTLASHDDDNDDRATQGSISLSDDGANDDESESKRRKTESCLTEMNVASGALREPRVVVQIESDVDILDDGYRWRKYGQKVVKGNPNPR

SEQ ID NO: 5874 - protein, 398 aa, Physcomitrella patens subsp. patens
MPGVSAARAERLLVLCATAIQNQNAPVVQQAVQALQSISSIDGEPNERVTAYFLRALSIRADSRSESAFRIAEVQWGDRRLGFNELTNLVDMTPYYRFGYMAANGAILEALEGVDRVHIIDFSTSHCMQWPTLIDALADRMGGPPHVRLTVASGSLPTPPRLQPTYEEVGHRLALWAGEKKVPFEFRILSRPLERLRTKDIDLRDGESLAVNCSLRLHYLADESAGFVSEASSETIFSPRDKFLQLIRGLNPTVVTLYEEDCNTTSVDLVTRLKEAYNHEWISFDYLATYSQNGSHGRLELERAVGQKIENIIACENFHRIERLESKSQWAQRMQRLNFRALPVSEDVVAALREMVGDYAVGWGMKLDEDDVQVLSWKGHSLAFASSWVPYETPSKLA

SEQ ID NO: 5875 - protein, 391 aa, Coprinopsis cinerea okayama7#130
MLCRERRSWTAKEDQLLREAVNKEDPNNPNPSKWHAIAKHVPNRTNKDCRKRWFAKMASDVVKGGWSPEEDERLVKGIERYGTRWSLVASVVQTRNSDQCAKRWTDTLNPAIDRTTWTSEADEILLRAVEEHGKVWTKIVKTYFPGRTGLSAKNRYNSITRFNHDNGRGARSRRKSESVDGGYFSTSKTESVSSSSSASPTTPSLGLPMGSPPMSFSLTGAHLPPYDSLSGWQSPSSIVSDDLSPIQGYGRNVPSSGSSNASSDSSYQSVDLSMPALTPTEMGQSLAVYGNGTLLQGGDYFKASSTSSPRIVEHNNFLSSQAASDPIPSTYSQYPAIYNGNSSDLNNHFSSLDTMPNHIDSLGNISWDSSLSSAALEVKLKRSPSEFTYMY

SEQ ID NO: 5876 - protein, 171 aa, Physcomitrella patens subsp. patens
MSRLAPKVPVGFRFHPTEEELVGYYLPKKVSDRRIDLDLIRELDLYKFEPWDLHRECKPSHSDASQIDYYFFSRKGKKYPTGTRANRATTMGFWKATGRDKPIHTKLNQTLIGMRKTLVFYQGRAPHGIKTDWIMHEFRLDDGSERPTHDGGWVVCRVFKKNKNLMMEMQQ

SEQ ID NO: 5877 - protein, 503 aa, Zea mays
EKSLGEPPDSESPATRLIAGVEFQASDYRASKPFASTELNPQSVVAMDQIATPDETAHASAPSVHKLFDAKLGHHSVMDGTLASTSQSSNIKTQLIRSSSLSRSISVNLEKRSPESDPESPQSHVSHPKFAEPMFSNSSTFCTSLFSSSSTTEPCRQMGTLPFLPHPPKCEQQVSAGHSSSSSLLLSGDTGLDVAEQSDDLNDLLNLSGDASDGSFHGENNALAFDEQMEFQFLSEQLEIAITDNEKNPHLDDIYGTPPQLSSLPVSSCSNQNLGSPVKVQLSSSQSSSSSATANKSRLRWTLELHERFVEAVKKLEGPEKATPKGVLKLMKVEGLTIYHVKSHLQKYRLAKYIPEPKDDKKASSEDKKAQLGKGSIDSSKNKNLQVAEALRMQIEVQKQLHEQLEVQRQLQLRIEEHARYLQKILEEQQKAGNVPLKAPTKAQATKSSPESTSDERTESEVDTISPRPPKNRNPGVDAECKSPGRIKRTKVQADLENEGLCS

SEQ ID NO: 5878 - protein, 67 aa, Physcomitrella patens subsp. patens
QDYIHVRARRGQATDSHSLAERVRREKISERMKYLQDLVPGCKKVTGKAVMLDEIINYVQFLQRQVE

SEQ ID NO: 5879 - protein, 183 aa, Brassica napus
  misc_feature (148)..(148): Xaa can be any naturally occurring amino acid
  misc_feature (177)..(177): Xaa can be any naturally occurring amino acid
  misc_feature (182)..(182): Xaa can be any naturally occurring amino acid
DFQISQGGQWVSLIRALGARPGGPPRVRITGIDDPRSSFARQGGLELVGQRLGKLAEMCGVPFEFHGAALCCTEVEIEKLGVRNGEALAVIFPLVLHHMPDESVTVENHRDRLLRLVKRLSPNVVTLVEQEANTNTAPFLPRFVETMXHYLAVFESIDVKLARDHKERINVEQHCLXREVVXK

SEQ ID NO: 5880 - protein, 405 aa, Triticum turgidum subsp. dicoccoides
MGSSDSSSGSAQKATRYHHQHQPPPPQRGSAPELPPGFRFHPTDEELVVHYLKKKADKAPLPVNIIAEVDLYKFDPWELPEKATIGEQEWYFFSPRDRKYPNGARPNRAATSGYWKATGTDKPILASGTGCGLVREKLGVKKALVFYRGKPPKGLKTNWIMHEYRLTDASGSTTATNRPPPVTGGSRAAASLRLDDWVLCRIYKKINKAAAGDQQRNTECEDSVEDAVTAYPLYATAGMTGAGAHGSNYASPSLLHHQDSHFLDGLFTADDAGLSAGATSLSHLAAAARASPAPTKQFLAPSSSTPFNWLDASPVGILPQARNFPGFNRSRNVGNMSLSSTADMAGAVDNGGGNAVNAMSTYLPVQDGTYHQQHVILGAPLVPEAAAATSGFQHPVQISGVNWNP

SEQ ID NO: 5881 - protein, 330 aa, Oryza sativa Indica Group
MPGELNFHLLHSLDAAAAAASSTPASASSQPTVDYFFGGADQQQPPPAAVQYDQLAAPHHHQTVAMLRDYYGGHYPPAAAAAAATEAYFRGGPRTAGSSSLVFGPADDESAFMVGPFESSPTPRSGGGRKRSRATAGFHGGGPANGVEKKEKQRRLRLTEKYNALMLLIPNRTKEDRATVISDAIEYIQELGRTVEELTLLVEKKRRPEGDAGGRGGRGGVVGGGGDGSGGGELGGRGDGGGDGGGGAAAAAGADPEHDDVNIKLTKRRRDGCLAAASRALDDLRLDLVHLSGGKIGDCHIYMFNTKIHPGSPVFASAVASRLIEVVDEY

SEQ ID NO: 5882 - protein, 600 aa, Triticum aestivum
MTNNNGNGNGGSNAAASGWLGFSLSPHMDEHNHVQQQQQHQGLFYPSSVAAAYSLGGDVATGGYYSQLASMPLKSDGSLCIMEALRRTDQQDHNGPKLEDFLGAGQPAMALSLDNTSNFYYYGGGGGAGGQHGQSHGGCFLQQAYDVYGGPATASVLAADEDAAAATAMANWVQVARGATAYATAENVLSAAADRQQHLHHHPLALSMSSAGSLSSCVTAGAEYGGVVATVDGGRKRGGATAGQKQPVHHRKSIDTFGQRTSQYRGVTRHRWTGRYEAHLWDNSCKKEGQTRKGRQVYLGGYDMEEKAARAYDQAALKYWGPSTHINFPLEDYQQELEEMKNMTRQEYVAHLRRKSSGFSRGASMYRGVTRHHQHGRWQARIGRVSGNKDLYLGTFGTQEEAAEAYDIAAIKFRGLNAVTNFDITRYDVDKIMASNTLLPGELARRNKDANAAPLPLPAPDDCAASALVPVSTPGTDTGGSGQHRHHDVMSSGEAFSALHDLVTVDGHTAQGGNGAHVHMSMSGASSLVTSLSNSREGSPDRGGGLSMLFAKPPQQPATTTAASPKLMSTLAPLGSWASSARPAAVSIAHMPMFAAWSDA

SEQ ID NO: 5883 - protein, 817 aa, Saccharomyces cerevisiae
MAGAPAPPPPPPPPALGGSAPKPAKSVMQGRDALLGDIRKGMKLKKAETNDRSAPIVGGGVVSSASGSSGTVSSKGPSMSAPPIPGMGAPQLGDILAGGIPKLKHINNNASTKPSPSASAPPIPGAVPSVAAPPIPNAPLSPAPAVPSIPSSSAPPIPDIPSSAAPPIPIVPSSPAPPLPLSGASAPKVPQNRPHMPSVRPAHRSHQRKSSNISLPSVSAPPLPSASLPTHVSNPPQAPPPPPTPTIGLDSKNIKPTDNAVSPPSSEVPAGGLPFLAEINARRSERGAVEGVSSTKIQTENHKSPSQPPLPSSAPPIPTSHAPPLPPTAPPPPSLPNVTSAPKKATSAPAPPPPPLPAAMSSASTNSVKATPVPPTLAPPLPNTTSVPPNKASSMPAPPPPPPPPPGAFSTSSALSASSIPLAPLPPPPPPSVATSVPSAPPPPPTLTTNKPSASSKQSKISSSSSSSAVTPGGPLPFLAEIQKKRDDRFVVGGDTGYTTQDKQEDVIGSSKDDNVRPSPISPSINPPKQSSQNGMSFLDEIESKLHKQTSSNAFNAPPPHTDAMAPPLPPSAPPPPITSLPTPTASGDDHTNDKSETVLGMKKAKAPALPGHVPPPPVPPVLSDDSKNNVPAASLLHDVLPSSNLEKPPSPPVAAAPPLPTFSAPSLPQQSVSTSIPSPPPVAPTLSVRTETESISKNPTKSPPPPPSPSTMDTGTSNSPSKNLKQRLFSTGGSTLQHKHNTHTNQPDVDVGRYTIGGSNSIVGAKSGNERIVIDDSRFKWTNVSQMPKPRPFQNKTKLYPSGKGSSVPLDLTLFT

SEQ ID NO: 5884 - protein, 509 aa, Candida albicans SC5314
MSEEGAHIDKKAKIEDTDMSEESNQQVFSTVGEQAQEVDNAIKQTGAADAEGHPVQEVESLCMNCHKNGVTRMLLTRIPYFREVIIMSFECPHCGFKNSEIQPAAQIAEKGARYVLKVENKKDFNRQIVKSETATVKFTELDIEIPPKRGQLINVEGILQEMIDDLESDQPQRQKVQPEVYEKIDQVISKIKSFINCDPNTVPLTVTVDDPAGNSWIEYVPGEPTHKWAMYEYNRTAEQNVFLGLISADDVAQHRQAELANKKQATDSNISSNLNKEQSQSQSQSQEEHSNPHTTGFKSDASEIENFSNEVQTFAATCSSCYKPCETHMKTVNIPHFKDVILMSTVCDHCGYKSNEVKTGGAIPEKGKRITLKVTDPEDLARDILKSETCGLNIPELNLDLTPGTLGGRFTTIEGLLTQVLEELHSRVFTQTSDSMDDETKTRWTGFFARLQDAIDGKIGFTIVMEDPLASSYIQNVYAPDNDPNMTIEEFERTFDQNEGLGLNDIKTD

SEQ ID NO: 5885 - protein, 146 aa, Triticum aestivum
TMSEDEDEGPPMIMEAAPMDMSSNGHDMMGFGPLVPTDTERSLMERVRQELKIELKQGFKSRIGDVREEILRKRRAGKLPGDTTTILKQWWQEHAKWPYPTEDDKAKLVEETGLQLKQINNWFINQRKRNWHNNSQTSTLKSKRKR

SEQ ID NO: 5886 - protein, 341 aa, Zea mays
MAAAIDMYKYYNTSAHQIPSSSPSDQELAKALEPFITSASSSSSSSPYHGYSSSPSMSQDSYMPTPSYTSYATSPLPTPAAASSSQLPPLYSSPYAAPCMAGQMGLNQLGPAQIQQIQAQFMFQQQQQQQRGLHAAFLGPRAQPMKQSGSPSPPPPLAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTEGEGEEESGSAGSPPPPPPPPTLAPPVPEMAKLDFTEAPWDETEAFHLRKYPSWEIDWDSILS

SEQ ID NO: 5887 - protein, 250 aa, x Aranda deborah
MGRGRVELKMIENKINRQVTFAKRRKRLLKKAYELSVLCDAEVALIIFSNRGKLYEFCSSTSMLKTLEKYQKCNFGSPESTIISRETQSSQQEYLKLKNRVEALQRSQRNLLGEDLGPLGSKELEQLERQLDSSLRQIRSTRTQFMLDQLADLQRREQMLCEANKTLKRRFEESSQANQQQVWDPSNTHAVGYGRQPAQHHGEAFYHPLECEPTLQIGYHSDITMATATASTVNNYMPPGWLGQISGSYE

SEQ ID NO: 5888 - protein, 154 aa, Triticum turgidum subsp. dicoccoides
KLMKVEGLTIFHVKSHLQNYRHVKYIPEKKEVKRTCSEDNKPKSAPGIDSGKKKSFQMAEALRMQMEVQKQLHEQLEVQRKLQLRIEEHARYLQQILEQQKARKSPVPKPKEETEVNTTSAPSLKRKLSDTKIEHNSQMDSRRPELQLDLESEP

SEQ ID NO: 5889 - protein, 270 aa, Zea mays
MGRGKVQLKRIENKINRQVTFSKRRNGLLKKAHEISVLCDAEVAVIVFSPKGKLYEYASDSRMDKILERYERYSYAEKALISAESESEGNWCHEYRKLKAKIETIQRCHKHLMGEDLESLNPKELQQLEQQLESSLKHIRSRKSHLMAESISELQKKERSLQEENKILQKELSERQKAVASRQQQQQQVQWDQQTQVQVQTSSSSSSFMMRQDQQGLPPPQNICFPPLSIGERGEEVAAAAQQQLPPPGQAQPQLRIAGLPPWMLSHLNA

SEQ ID NO: 5890 - protein, 247 aa, Zea mays
MARERREIKRIESAAARQVTFSKRRRGLFKKAQELSVLCDADVALIVFSSTGKLSQFASSSMNEIIDKYNTHSKNLGKTEQPSLDLNLCISFQLEHSKYANLNEQLAEASLRLRQMRGEELEGLNVEELQQLEKNLESGLHRVLPTRDQQFLEQISDLEQKLPKSWHVLSLFQISTQLAEENRQLRNQVSHIPPVGKQSVADTENVIAEDGQSSESVMTALHSGSSQDNDDGSDVSLKLGLPCVAWK

SEQ ID NO: 5891 - protein, 267 aa, Antirrhinum cornutum
HLPQVSSSLHSRGATSVVDLNGNEIQLHHMLSGHYLTPGANAPVLESTTLFNNNFNPDVVNGLNRDPSPIFPTKQAVKKDRHSKIYTSQGPRDRRVRLSIGIARKFFDLQEMLGFDKPSKTLDWLLTKSKTAIKELVQSKSTKSNSSSPSDDCEEVVSVDSENVTDHSKGKSVLLKANNKCKEAMDLAKESRAKARARARERTKEKMCIKQLNEAIVRNHQLEAPGTREAFVHPVFGFHQQNYGNTSHENWDQNNFASQSNQLCAIL

SEQ ID NO: 5892 - protein, 194 aa, Mirabilis jalapa
MMKNDMNKSGGGVIAKDVNDNTKVNGANNNADLAKPPAKAQVVGWPPVRSYRKNMLAVQKSTGAPESESEKPAANGGLVKVSMDGAPYLRKVDLKLYKSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 5893 - protein, 227 aa, Solanum lycopersicum
MGRGRVQLKRIENKINRQVTFSKRRSGLLKKAHEISVLCDAEVGLIVFSTKGKLFEYANDSCMERILERYERYSFAEKQLVPTDHTSPVSWTLEHRKLKARLEVLQRNQKHYVGEDLESLSMKELQNLEHQLDSALKHIRSRKNQLMHESISVLQKKDRALQEQNNQLSKKVKEREKSAQQISGINSSSLFAHTDFYLGTYQSTNVIDNGKWKEVVLHSSKVQLIIL

SEQ ID NO: 5894 - protein, 255 aa, Vitis vinifera
MSSGGNTHWCYRCRRPVRLRGRDAVCPNCNGGFIQELNDMISLDWTLMKIFFGMDPMELVRHGVMLQLSVNDRRGPPPASRSSIDAMPTIKITQKHLRSDSHCPVCKDRFELGSEARKMPCNHIYHSDCIVPWLVQHNSCPVCRHELPPQGSSRGHSHQTSSSGNRSSSYSSNSNGRENDEVHGRFCGHSAHLTLVLTTTKQVEAAQQLCMKIFTNRRGIMDGLLIKVSMFRTWFASFHRTLRSMAPIQPTIAWR

SEQ ID NO: 5895 - protein, 267 aa, Antirrhinum coulterianum
HLPQVSSTLHSRAATSVVDLNGNEIQLHDMLSGHYLTPGANAPVLDSTALFNNNFNHDVVNGLNRDPSPTFPTKQAVKKDRHSKIYTSQGPRDRRVRLSIGIARKFFDLQEMLGFDKPSKTLDWLLTKSKTAIKELVQTKSTKSNSSSPSDDCEEVVSVDFENVTDHSKGKSVLLKANNKCKEAMDLAKESRALARARARERTKEKMCIKQLNEAIVRNHRLEVSGTREAFVHPVFGFHQQNDGNTSHENWDQNNFASQSNQLCAIL

SEQ ID NO: 5896 - protein, 102 aa, Kluyveromyces lactis
GSRRASVGSMARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 5897 - protein, 292 aa, Nicotiana tabacum
MSQRTVPAPFLTKTYQLVDDATTDDVVSWNESGTTFVVWKTAEFAKDLVPTYFKHNNFSSFVRQLNTYGFRKIVPDKWEFANENFKRGQKELLTAIRRRKTVTPTPAGGKSVVPGTSASPDNSGEDLGSSSTSSPDSKNPGSVDTPGKSQFADLSDENEKLKKDNQMLSSELAQAKKQCDELVAFLNQYVKVAPDMINRIISQGTSGSSYGELVKEVIGGVNDLEAQGSDDDEKGDTLKLFGVLLKENKKKRGPDENADISGSRGKMMKTMDYNLPWMKMSSAPGESNKVCN

SEQ ID NO: 5898 - protein, 408 aa, Nicotiana tabacum
MDEATCSTNALPPFLTKTYEMVDDPSSDAIVSWSSSNKSFVVWNPPDFARDLLPRYFKHNNFSSFIRQLNTYGFRKVDPEKWEFANEDNFFRGQPHLLKNIHRRKPVHSHSAQNLHGLSSPLTESERQGYKEDIQKLKHENESLHLDLQRHQQDRQGLELQMQVFTERVQHVEHRQKTMLSALARMLDKPVTDLSRMPQLQVNDRKRRLPGNSCLYNETDLEDTRAISSRALTWENMNPSSLLTINAELLNQLDSSLTFWENVLQDVDQAWIQQNCSLELDESTSCADSPAISYTQLNVDVGPKASDIDMNSEPNANTNPEVAAPEDQAAVAGTTTNVPTGVNDIFWEQFLTENPGSVDASEVQSERKDIGNKKNESKPVDSGKFWWNMKSVNSLAEQLGHLTPAEKT

SEQ ID NO: 5899 - protein, 124 aa, Glycine max
MCKGAEGEKQHGFCSSFLHKESATRSAICCELCGLQASLYCQADDAYLCKKCDKRVHEANFLALRHIRCFLCNTCQNLTRRYLMGASLEVVLPANINWTIRNLLNNRGIYRKCSRMHNSPSLFL

SEQ ID NO: 5900 - protein, 261 aa, Arabidopsis thaliana
METASLSFPVPNTSFGVNKSMPLGLNQLTPYQIHQIQNQLNHRRSTISNLSPNRIRMKNLTPSTSKTKNLYRGVRQRHWGKWVAEIRLPKNRTRLWLGTFETAEKAALAYDQAAFQLRGDIAKLNLPNLIHEDMNPLPSSVDTKLQAICKSLRKTEEICSVSDQTKEYSVYSVSDKTELFLPKAELFLPKREHLETNELSNESPRSDETSLLDESQAEYSSSDKTFLDFSDTEFEEIGSFGLRKFPSVEIDWDAISKLANS

SEQ ID NO: 5901 - protein, 267 aa, Antirrhinum leptaleum
HLPQVSSSLHSRAATSVVDLNGNEIQLHDMLSGHYLTPGANAPVLESTALFNNNFNHDVVNGLNRDPSPTFPTKQAVKKDRHSKIYTSQGPRDRRVRLSIGIARKFFDLQEMLGFDKPSKTLDWLLTKSKTAIKELVQSKSTKSNSSSPSDDCEEVVSVDSENVTDHSKGKSVLLKANNKCKEAMDPAKESRAKARARARERTKEKMCIKQLNEAIVRNHQLEVSGTREAFVHPVFGFHQQNYGNTSHENWDQNNFASQSNQLCAIL

SEQ ID NO: 5902 - protein, 332 aa, Zea mays
MALEAVVLSQQGSRFGCGAMAAGGPWSGLFFSGMEGVVEIGSGAGGGRDVAGCSPPQLLQEPAARALPVASSVGSASGGAGQDAPAALAVTATAAAGTGRRKRRRMRPLKNEEEVESQRMVHIAVERNRRKQMNEYLAALRSLMPPAYTQRGDQASIVGGAINFVKELEQLLQSLEAQQRRSSRRQGPACAVDPDDAGPFADFFTFPQYSMCAAAAAPSENPGADADAEQEASGSKPSGVADVEATMVESHANLRVLSRRRPRQLLRLVLGLQGYRLTVLHLNMSSAGHMVLYSFSLKVEDDCPLTSVDEIAGAAHQIVEKINEEQGGGSLE

SEQ ID NO: 5903 - protein, 323 aa, Brassica rapa
MAPMTNWLTFSLSPMEMLRSSDDQSQFVSYDASSAASSSPYLLDNFYGWTNQKPQELFFKEAAAASMADSTILTTFVDQQTHSQSHIPKLEDFLGGDVRYSDNSQSETQDSSSLSQIYDPRHHQNQNQNQTGFYSDHNPDFNKTMAGFQTAFSTNSGSEVDDSASIARTHLAGEYLGHAVESSGPELGFHGGANNTGGALSLGVNINNNANQRTSSDNYQIVEHHYNVERINNNSEKRDSEKEKPVVTVETSDCSNKKVADTFGQRTSIYRGVTRHRWTGRYEAHLWDNSCRREGQARKGRQGIFFCFFIFLNLIFHYYYKLC

SEQ ID NO: 5904 - protein, 267 aa, Antirrhinum nuttallianum
HLPQVSSSLHSRAATSVVDLNGNEIQLHDMLSGHYLTPCANAPVLESTALFNNNFNYDVVNGLNRDPSPTFPTKQAVKKDRHSKIYTSQGPRDRRVRLSIGIARKFFDLQEMLGFDKPSKTLDWLLTKSKTSIKELVQSKSTKSNSSSPSDDCAEVVSVDSENVTDHSKGESVLLKANNKCKEAMDLSKESRAKARARARERTKEKMCIKQLNEAIVRNHQLEVSGTREAFVHPVFEFHQQNYGNTSHENWDQNNFASQSNQLCAIL

SEQ ID NO: 5905 - protein, 402 aa, Arabidopsis thaliana
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLEVQRHLQLRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTALDLNTHDENYGTTRPKQFDLNGFSWN

SEQ ID NO: 5906 - protein, 242 aa, Brassica rapa
MIGELINLKATELCLGLPGGAEANENLEKSAVGNKRGFSETVDLMLNLQSNKEGAVDLNNVASASKDKTLLKDPAKPPAKAQVVGWPPVRNYRKNIITQQKTSGKEEASSEKAGNSGGGASGAALVKVSMDGAPYLRKVDLKMYKSYKDFSDALAKMFSSFTMGKYGAQGMIDFMNESKLMDLLNSSEYVPSYEDKDGDWMLVGDVPWEMFVDSCKRLRIMKGSEAIGLAPRAMEKYCKNRS

SEQ ID NO: 5907 - protein, 373 aa, Vitis vinifera
MDALFINTSLSRLKLSPKPTSLSPLPSLPLHSLHLRPSRRFNLTVSQKQFEETEELLKDEVFDSYNEDESYGEVSKIIGSRAAEGEKGMEYLIEWKDGHVPTWVPARYVAGDVVAEYESPWWTAAKKADDAALKALLESGDGRDVDAVDENGRTALLFAAGLGSEACVQILADAGADLNHRDNGGGGLTALHMAAGYVKPGVARLLIQLGADPEAEDDRGRTPLDLAREMLRATPKGNPMQFARRLGLENVVRVLEEAIFEYAEVQEIMERRGKGQNLEYLVKWKDGSDNEWVKAGLIAEELVRDFEAGLEYAVAQGVMGKRTGDDGNMEYLVKWTDIDEATWEPEENVDPDLIKAFEENGAADLGAHVEGGS

SEQ ID NO: 5908 - protein, 207 aa, Theobroma gileri
KKVERSLDGQITEIIYKGAHNHPNPLPCRRPSIGSTLSSDEMSEIAEGGGTCVKVEGGLIWRNAQAGSRDIKLGSDWRADGLERTSSTSVVTDLSDPLSTAQGKSVGAFESAETPEFSSALASHDDDNDDRATQGSISLCDDAANEDESESKRRKTESCLMEMNAASGALREPRVVVQIESDVDILDDGYRWRKYGQKVVKGNPNPR

SEQ ID NO: 5909 - protein, 104 aa, Triticum aestivum
GPIDPSDDSWLDLPAGSRGFGLGAAVTAVTGGEREARVSRYREKRRTRLFAKKIRYEVRKLNAEKRPRMKGRFVKRTALPPLPPRPPMVLAAHGHGGAHGRFRF

SEQ ID NO: 5910 - protein, 207 aa, Theobroma grandiflorum
KKVERSLDGQITEIIYKGAHNHPKPLPCRRPSIGSTLSSDEMSEIAEGGGTCVKVEGGLIWRNAQAGSRDIKLGSDWRADGLERTSSASVVTDLSDPLSTAQGKSVGAFESAETPEFSSTLASHDDDNNDRATQGSISLCDDAANDDESESKRRKTESCLTEMNAASGALREPRVVVQIESDVDILDDGYRWRKYGQKVVKGNPNPR

SEQ ID NO: 5911 - protein, 245 aa, Zea mays
SAAAPTPAVVVSAPTPALHSPLGPLGELVACASGANFTPHIINVAAGEDVSMKVISFSQQGPRAICILSANGVIANVTLRQQDSLGGTVTYEGRFELLSLSGSFTPTDSGGGTRSRSGGMSVSLAAADGRVIGGGVAGLLVAASPVQVVVGSFLPSYQLDQGANKKPVIEITTVPPAPVGFTISSGDMDDAYSGSQHPRSAAAKGGSTTTALFKVENWTAPVPAPDQARKAPAPAPEAKVPVPGG

SEQ ID NO: 5912 - protein, 356 aa, Populus trichocarpa
MGSTSTQIAAMRGMGFYEPFHQISSWGHAYRDDGSLNIGPSTIVQVDAGLDNKTEHVSHESMEPSRSDQEAHKPADKIQRRLAQNREAARKSRLRKKAYVQQLESSRLKLAQLEQELERARHQGAYIGGSASDSSHLGFSGTGNPGIAAFEMEYGHWVEEQLKQISELRNALQARITDIELRILVENGLNHYNNLFRMKTDAAKADVFYLISGKWRTSVERFFLWIGGFRPSELLNVLMSQLEPLTDQQLADVCNLRQSSQQAEDALTQGIDKLQQTLSQSIAADVMGDGGYGDKMADELEGFVNQADHLRQQTLHHMSRILTIRQAARGLLALGEYFHRLRTLSSLWAARPCEPA

SEQ ID NO: 5913 - protein, 418 aa, Glycine max
MALLTSLPEQFSITPKRHKRKPQQQQQKQKQKQKQKQKQKPASSWDQIKNLLTCKQMEESRVHDPSKITGYSKLGSSCSSICSFRDVVHGNTRVVHRSDNSSPESSSLGQETNGLLTRKPVTTTTTTTTRSSAKSNGGATCTSSSSSSRGMQFRKLSGCYECHMIIDPSRLPIARSTVCACSHCGEVFPKMESLELHQAVRHAVSELGPEDSGRNIVEIIFKSSWLKKDNPICKIERILKVHNTQRTIQRFEECRDTVKNRALGSTKKNPRCAADCNELLRFHCTTLTCALGARGSSSLCASVPGCSVCTIIRHGFQGGCGGGGDHARAKGVRTTASSGRAHDSVVCGDATRRAMLVCRVIAGRVKRVVEDAPSEEEHVSYDSVAGYAGIYSNLEELVVFNPKAILPCFVVIYKVPLC

SEQ ID NO: 5914 - protein, 681 aa, Nicotiana glutinosa
MVSKKKLDFGFNGFQVPFIPKAPRSVRRRGTCKKFDDDQICAFELLAAVAGKLLQESESSTSSNAAEGKYELSDCRDGIKCEQVEEDKAVKSECLDQGSCVESAYVPEPAVREQNLKRDLDKPYYAENSSILEQHTSTVIGSDSDMTLENCKEVNVADGNFPAKVEDFDSKISGTQKHLDDDSKQIDDLTVTNACRVKGPIEKHVNNNALFNSESSVQLSLYRDLVPRASFVKQRNSVKLGVRDDDDNSFGCYRYSTKLRTFRTTSRIGYRRIRKMLTSRRWKVAPKLKEYERSYTNGGVESFYVSGKSGRARKRCQPEVPSKRRKLSDHGFAFAYYQEASSESISNSPEKGIKRDTNTSHAIPPRGTADSVTVKNHHKKDPNVKFSIKSFKVPELYIEVPETATVGSLKRTVMEAVTAILESGLRVGMVLQGKKVRDDSRTLEQAGISQNGNLDNLGFTLEPRFTQVSPSLSPNDRPASSAYVADQELTRLPPSPSSELGITNASSDPPATTLDKHHENNFSAELFPTNSVDPSTDIAIPDSRALVIVPPVNPEALAMVPVNQKSKRSELSQRRIRRPFSVAEVEALVEAVEHLGTGRWRDVKMRAFDNADHRTYVDLKDKWKTLVHTASIAPQQRRGEPVPQDLLDRVLAAHAYWSQQQGKQHVEPLKILDAKAQKVGA

SEQ ID NO: 5915 - protein, 207 aa, Theobroma microcarpum
KKVERSLDGQITEIIYKGAHNHPKPLPCRRPSIGSTLSSDEMSEIAEGGGTCVKVEGGLIWRNAQAGSRDIKLGSDWRADGLERTSSTSVVTDLSDPLSTAQGKSVGAFESAETPEFSSALASHDDDNDDRATQGSISLCDDAANEDESESKRRKTESCLMEMNVASGALREPRVVVQIESDVDILDDGYRWRKYGQKVVKGNPNPR

SEQ ID NO: 5916 - protein, 646 aa, Petunia x hybrida
MSVMRRLSQKNWRDGCGRTVSSLSGSRKDRNLQPCKLLRSRTISKLVIRLGGKKMSRAQDGILKYMLKMMEVCNARGFVYGIIPDKGKPVSGASDNIRAWWKEKVKFDKNGPAAIAKYEAECLAREERVGSQNGNPQSVLQDLQDATLGSLLSSLMQHCDPPQRKYPLEKGVSPPWWPTGNEEWWAKTGLPKGQKPPYKKPHDLKKMWKVGVLTAVIKHMSPDIAKIRRLVRQSKCLQDKMTAKESSIWLAVLSREESILQQPGSENRSSSLEPPPRSRGEKKKPSSSSDSDYDVDGFDDGIGSVSSRDERRNQPLDVRPLNVVPPSHQSKEQGDGRYRRRKRARSNPTEQQIQPSLIHGDEHSNTILDINSSQTLFVGCITNESLLLNDKSEAPKRAENESESQPELPLQDSNLSFVPSANVVSIEDAYIGAGPSLNIMSQNSAVVPYESGMHLGSQDSAIQHQFQDTQFHGCHKVSGMNNGPQSSSLHYGTPNNGLHYGPHNSVVRTELQDSAFVHGSEYSNINQPPMYHSYSSAEFGSAHEETQSHLACNELQIRPINSGVGSSVLNGTGNDIIGDNHHYGKDIYQNNHDRQIEMPFPSPLTIGSPDYALGSPFNLGLDIQSHLDSPDYDLDFDKEFMSFFAS

SEQ ID NO: 5917 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLAEASLRLSQMRGEELEGLSVEELQQLEKNLESGLHRVLQTKDQQFLEQISDLERKSTQLAEENRQLRNQVSQIPPAGKQAVADTENVIAEEGQSSESVMTALPSGSSQDNDDGSDVSLKLGLPCVAWK

SEQ ID NO: 5918 - protein, 305 aa, Brassica napus
MADRIKGPWSPEEDEQLRRLVVKYGPRNWTVISKSIPGRSGKSCRLRWCNQLSPQVEHRPFSAEEDATIARAHEQFGNKWATIARLLNGRTDNAVKNHWNSTLKRKCGGFDHRYDASAEDQRPVKRSVSDGYPPVANGLYMSPGSPTGSDVSDSSTLPVLPSVEVFKPVPRAGGVMLPLPIETSSFCDDPATSLSLSLPGADVSEESNRSHESTNNNTSRSHNTNTMSLMQFSGGFRGAIEEMGRSFAGDGGSEFMAVVQEMIKAEVRSYMAEMQRNHNGGGFVVGGFRDNGMIPMSQVGVGRIE

SEQ ID NO: 5919 - protein, 2135 aa, Oryza sativa Japonica Group
MAPPRELDLSDEVEGEEDGTTDFVFRLAGDPIPLLPTTSSPLPLFDLQSPPSRPLAVSNRRAAVFLAHPNGFMAATTKALIEASKEAREKGKSTTRCARDCCVADIPLPGVSLLELSRDESVLAACAGSVIHFFSASSLLTDKDVEPLSSCTLEGSSTVKDFKWLNHASKAFIVLSKDGLLSQGSLGEGLKDIMENVDAVDCCKEGTHIVLSKKNTLNILSSDFKEICCMPLLFQLWSDDSDSDDASIKVDSIGWVRDDSIVVGSVRLNEEGNEEGYLVQVIRSGGNTFFENSSKSVVFTYVDFFRGIMDDVLPSGVGPNLLLGYLHRWDLMVTSNKKSIDEHISLLKWSSATDDKKTVVYLEMLEDKYSPRIDLQENGDDNVILGFGVENVSLFQKITVTVGPEQKEVAPQHILLYLTGEGKLNIYYLARISDPSELPQTKLSAIEDSDVMKEISPVTVSGKEFTPSATSSLDKSIRPDGAELSSVQPDRDLHGSTDMKNSSPVSKAKEIVASSPAPASFLAPASNLKPGISFSFSTANSVSLSPAGSNTSSELGSSWQQSSSSNFVNNQLGKGSIPSTQPVGAFGGSQNSKKDGNLSFNKSSVFTSDGSTLVKPGERNEPGFGSHPLQSSYTTDKKVPSSVGLSSKSSPSISPIKPSSAGPSSTGFRTGNLEAFPTSRGSPLPQESIDKPHDRTHAVVDHSKNFKLGAMFDTEQDLSKKFYSINDMTKELDTLLSYIEKDGGFRDACITFQERPLSMFEGDLQNFLELLQIFKNKIAEQCSRVEDLRNKMFQGTSTTRVSARQAYMKGIVDQSSDTQYWDIWNRQKLSPEFEAKRQNILKANQNLTNQLVELERHFNNLEMNKFGETGRVASSRRAIYSSKARSSQTQISSVYNALNSQLAAAEQLSDCLSKQISALNISSPSTKRGSVAKELFESIGLDHTMDAAKFSGGTPSKSVKRYPSTREHITSISGPSKTAEPETARRRRESLDRSLASLEPQKTTVKRIAQQQRLKISSDLPFRSNKKIFDSQMAAMSQEKSSSSPTSSIVESYANKLHYPSEVLHEKTKPSGPQHNTLFKWVKESAGPSQGPQHKYPELPGQLKSSDQTPKLGSSSPLSFSYSHKDVWDNISSSNVPSSGTTHTMPKSSTLTFKTTVIPKTNTSTLPDLSPLMTGSKFSLSPLTVKTLSGDSGGASSIITKNKQGGQAMPYLGTTKGLDVSPQNMGGAFRDLNKPSLSPEPPKSALLQGKTVQLGKITETVQSPVKAKPEVAFQPPAFPPTPVAQSSPCSIKPTVPSSATSSSSTMQESAAKTSDVLSPTGPSILPSKESMTKPSSPLPDGTISSSLLSIPMPVKESSTGLNKIVSKPEVVTSEVTGTTVSASTSSSVPITEGKPSSIPATSGSLPSIPVSAPKVVPVSAESVVVTSTGKDVGPSNPSSDEDDMEEEVPSASSDLNLGALGGFGLGSVPSSSPPKSNPFGNSFTTSDNKSSGSSFTLTTSPGQLFRPASLSIPSSQPAQSSQSTSSSTFSSAFSSGLSGFGQSAQIGSAQQSGFGQPSQIGAGQQAGFGQPAQIQSGFGQPAQVGVAQQSGFGQPAQIGTAQQSGFGQPAQFGAQQALGSVLGSFGQSRQLGSFGAGGFGGFASASASGGFSSNSGFAGGATGGGFSAAAAPAGGGFAAAATGGGFAALASKGGGFAAAASSGGGFGGAAQGSGFSSVALMHAPKIVLRALAVAIVELPAPGIDTISQEHFAYLSTSDIRTWVSHQDSLTNLDEIVSNHPTTSRQTFQCMTGTEQMMYHQQQVQSDSQHLSSRPGLPPEKQFLLQGGADSSSGLVLSTDAKPRLKWTSELHERFVEAVNQLGGPDKATPKTIMRLMGIPGLTLYHLKSHLQKYRLSKNLQSQANASRAQGVLGCSTTEIDKPCEGNGSPASHLDLETQTNSSSMHINEALQMQIEVQRRLHEQLEVQRHLQLRIEAQGKYLQSVLEKAQEALGTIAVAETAATANASSSKRLQNEHTQLHHHQQQQQVGDGSVDSCLTACDCEGSHHSRSHGHRGEQDILSIGLPPFEPAAARSGKEHHYLLFPNEPSRRRSCSDERRREMSTLQASELDLSINGRSSSHSHRRENIDLNGAGWS

SEQ ID NO: 5920 - protein, 267 aa, Antirrhinum ovatum
HLPQVSSSLHSCTGTSVVDLNGNEIQLHDMLSGHYLTPGANAPVLESTALFNNNFNHDVVNGLNRDPSPTFPTKQAVKRDRHSKIYTSQGPRDRRVRLSIGIARKFFDLQEMLGFDKPSKTLDWLLTKSKTAIKELVQSKSTKSNSSSPSDDCEEVVSVDSENVTDHSKGKSVLLKANNKCKEAMDLAKESRAKARARARERTKEKMCIKQLNEAIVRNHQLEVSGTREGFVHPVFGFHQQNYGNTSHENWDQNNFASQSNQLCAIL

SEQ ID NO: 5921 - protein, 586 aa, Oryza sativa Japonica Group
MVDRRMAFAAEADVDSKAAFGFFGGECFVGEGDLVNPAPPPPQQQQVHEGGFAAEDESDGDDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAAPEFRFSSNFNVTGGGAVDYGGAMQQPPAKYAGSNWFY

SEQ ID NO: 5922 - protein, 196 aa, Vitis vinifera
MEKSPRQKVVLTPGKNTENTSSSNKKILRRDMERQRRQEMANLNASLRSLLPLEYVKGKRSISDHMHEAVNYINHLQMKIQDLGTKRDELRNQSNMSACDSESGSSYKRSRHCVIVSPCMDGVEILISGGFKEGLLLSKVMEVLLEEGLGVHRCVSTKVNEGLLHTMNCKQVSDPTGFDLCGLRQKLWNAVTPSSR

SEQ ID NO: 5923 - protein, 267 aa, Antirrhinum subcordatum
HLPQVSSSLHSRTATSMVDLNGNEIQLHDMLSGHYLTPGANAPVLESTALFNNNFNHDVVNGLNRDPSPTFPPKQAVKKDRHSKIYTSQGPRDRRVRLSIGIARKFFDLQEMLGFDKPSKTLDWLLTKSKTAIKELVQSKSTKSNSSSPSDDCEEVVSVDSENVTDHSKGKSVLLKANNKCKEAMDLAKESRAKARARARERTKEKMCIKQLNEAIVRNHQLEVSGTREGFIHPVFGFHQQNYGNTSHENWDQNNFVSQSNQLCAIL

SEQ ID NO: 5924 - protein, 245 aa, Cocos nucifera
KQVKGSEFPRSYYKCTYPNCPVKKKVERSQEGHITEIIYKGAHNHPRLSHSFRSMQLEGWEQRGLQSGLHGEQHSKVNTRNGTSAHDGRNDGLEATLSPSLAAEFCDTSTSMPVTEGCTSCEIKDAMDVSSTLSNKQEENDLANHGSMSLGCDGEGDEIEPKRRKLDAGALEICASSKVVREPRVVVQTTSEVDILDDGYRWRKYGQKVVKGNPNPRSYYKCTNPGCTVRKHVERASHDLKSVIT

SEQ ID NO: 5925 - protein, 267 aa, Antirrhinum virga
HLPQVSSSLHSCAATSVVDLNGNEIQLHDMLSDHYLTPGANAPVLESTALFNNNFNHDVVNGLNRDPSPTFPTKQAVKKDRHSKIYTSQGPRDRRVRLSIGIARKFFDLQEMLGFDKPSKTLDWLLTKSKTAIKELVQSKSTKSNSSSPSDACEEVVSIDSENITDHSKGKSVLLKDNNKCKEAMDLAKESRAKARARARERTKEKMCIKQLNEAIVRNHQLEVSGTREAFVHPVFGFHQQNYGNASHENWDQNNFASQSNHLCAIL

SEQ ID NO: 5926 - protein, 266 aa, Antirrhinum vexillocalyculatum
HLPQVSSSLHSRTATSMVDLNGNEIQLHDMLSGHYLTPGANAPVLESTALFNNNFNHDVVNGLNRDPSPTFPTKQAVKRDRHSKIYTSQGPRDRRVRLSIGIARKFFDLQEMLGFDKPSKTLDWLLTKSKTAIKELVQSKSTKSNSSSPSDDCEEVVSVDSENVTDHSKGKSVLLKANNKCKEAMDLAKESRAKARARARERTKEKMCIKQLNEAIVRNHQLEVSGTREAFVHPVFGFHQQNYGNTSHENWDQNNFVSQNQLCAIL

SEQ ID NO: 5927 - protein, 260 aa, Mohavea confertiflora
SSSLHSRAATSVVDLNGNEIQLHDMLSSHYITSGANAPILESATLFNDNFNHDVVNGLNRDPSPTFPTKQAVKKDRHSKIYTSQGPRDRRVRLSIGIARKFFDLQEMLGFDKPSKTLDWLLTKSKTAIKELVQSKSNKSNSSSPSDDCEEVVSVDSENVTDHSKGKSVLLKANNKCKEATDLAKESRAKARARARERTKEKMCIKQLNEAIMRNHQLEVSGTREAFVHPVFGFHQQNYTSHENWDQNNFPSQSNQLCAIL

SEQ ID NO: 5928 - protein, 377 aa, Oryza sativa Indica Group
MHPSGGALSVPPGFRFHPTDEELLYYYLRKKVAYEAIDLDVIREIDLNKLEPWDLKDRCRIGTGPQNEWYFFSHKDKKYPTGTRTNRATTAGFWKATGRDKAIFLANACRIGMRKTLVFYVGRAPHGKKTDWIMHEYRLDQDNVDVQEDGWVVCRVFMKKSYQRGLNPADMAAVDDDDLLHHHHHPFPPAQLHGGAADHKHDGAGGHHHHHHLMQPHHHYDDFPSFDPSMQLPQLMSADQPPPPPPSLLPGVPPSAAAALSSLDVECPQNLMKLTSAAAGGGATGLLHAGGDHRFATAATDWSILDKLLASHQNLDQLFQGRVIAGASSPAAMAAPSHHQHLMDQLAGGGGGAASSLQRLPLQYLGCEAADLLRFSK

SEQ ID NO: 5929 - protein, 250 aa, Elaeis guineensis
MGRGRVQLRRIENKINRQVTFSKRRSGLLKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQEQNKMLEKELMEKQKVKALNQQAPWEQQGPPQTSSSSPTSFLIGDSLPTLNIGTYQCSGNEHGEEAAQPQVRIGNSLLPPWMLSHLNG

SEQ ID NO: 5930 - protein, 235 aa, Oryza sativa Indica Group
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAVAAAEAGYRMMKLAPPVTVAAVAQSDSDSSSVVDLAPSPPAVTANKAAAFDLDLNRPPPVEN

SEQ ID NO: 5931 - protein, 248 aa, Picea glauca
MEHLNAAAAQASSSLYGVSMAEYGDVGVSSMMALMTQHDPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 5932 - protein, 354 aa, Zea mays
MTSAGAATGAALGARTARSCDGCMRRRARWHCPADDAFLCQTCDVSVHSANPLARRHHRVRLPSASCSSPPRDPDAPTWLHGLKRRPRTPRSKPGGSKSNKHEATPSFIAAAASSAAVPDLEAEESGSGILGGNDDHHGFLQDDDEDLLYRVPVFDPMLAEFYNPVADEGEQKPACSLLMPSLAETSPEFASGGSAEADGLSVSFHVPDMELASFAADMESLLHGSRRRRKPQVNADLDAIVAPAPEPEDKKRKRPEMILKLNYEGVIASWVRDGGSPWFHGERPHLDCHELWSDDFTTGSRELFGGAVTPVTGGEREARVSRYREKRRTRLFAKKIRYEVRKLNAEKRPRMKG

SEQ ID NO: 5933 - protein, 151 aa, Elaeis guineensis
MGRGRVQLKRIENKINRQVTFSKRRSGLLKKAHEISVLCDAEVALIVFSTKGKLYEYSTNASMEKILERYQCYSYAERALVEEDPKSQGRWCHDYGELRSKVEALQKSQRHLMGEQLESLTFKELQQLELHLDGALRHIRSRRVNQSFSFH

SEQ ID NO: 5934 - protein, 207 aa, Theobroma speciosum
KKVERSLDGQITEIIYKGAHNHPKPLPCRRPSIGSTLSSDEMSEIAEGSGTCVKVEGGLIWRNAQAGSRDIKLGSDWRADGLERTSSTSVVTDLSDPLSTAQGKSVGAFESAETPEFSSTLASHDDDNDDRATQGSISLCDDAANDDESESKRRKTESCLMEMNAASGALREPRVVVQIESDVDILDDGYRWRKYGQKVVKGNPNPR

SEQ ID NO: 5935 - protein, 282 aa, Nicotiana sylvestris
MASPQENSTTLDLIRQHLLDDNVFLEHYCSETETTTLIYSQSSSSSESLDQSFSFEPTLNYATTAQSSNLEVSTFFNNSKTEFDSFEFGTIPNVSAARSSSLKQTSFKERKPSLNIAIPVKQEVVQKVELAPTEKKHYRGVRQRPWGKFAAEIRDPNRKGTRVWLGTFDTAIEAAKAYDRAAYKLRGSKAIVNFPLEVANFKQEFNNEIRPLVNSSRKRVRETVNEEQLVINKEMKIEEERVPTAPLTPSSWSAIWDSGDGKGIFEVPPLSPFGAYSQLVMI

SEQ ID NO: 5936 - protein, 227 aa, Nicotiana sylvestris
MAVKNKVSNGDLKGGNVKTNGVKEVHYRGVRKRPWGRYAAEIRDPGKKSRVWLGTFDTAEEAAKAYDTAAREFRGPKAKTNFPLPSENQSTSHSSTMESSSGETGIHAPPHAPLELDLTRRLGSVAADGGDNCRRSGEVGYPIFHQQPTVAVLPNGQPVLLFDSLWRPGVVNRPQPYHVMPMAMGFNGVNAGVDPTVSDSSSVVEENQYDGKRGIDLDLNLAPPTEF

SEQ ID NO: 5937 - protein, 366 aa, Oryza sativa
MTRRCSHCSNNGHNARTCPARGGGGGGGGVRLFGVRLTSPPEVAMKKSASMSCIASSLGSGGGSGGSSPAGTGRGGGGGGEGAAGYASDHPTHASCSTNGRGERKKGTPWTEEEHRMFLMGLQKLGKGDWRGISRNFVVSRTPTQVASHAQKYFIRQTNSSRRKRRSSLFDMVPEMPMDESPVVVEQLMLHSTQDEATSSNQLPISHLVKQKEPEFARHLSDLQLRKHEESEFTEPSLAALDLEMNHAAPFKTKFVLTMPTFYPALIPVPLTLWPPNVANVGESGTNHEILKPTPVNGKEVINKADEVVGMSKLTIGDGSSNSIEPSALSLQLTGPTNTRQSAFHVNPPMAGPDLNKRNNSPIHAV

SEQ ID NO: 5938 - protein, 305 aa, Oryza sativa
  misc_feature (57)..(57): Xaa can be any naturally occurring amino acid
  misc_feature (172)..(172): Xaa can be any naturally occurring amino acid
MLIHGEGSSSSAAAAGGKIKGSWSPEEDEQLRGAVARHGPRNWTAISEEVPGRSGKXSCRLRWCNQLSPGVHRRPFTPDEDALIVAAHAKYGNKWATIARLLDGRTDNSVKNHWNSSLRRNRRAAAAAAAAAASVSYQSMDLTEEADNDDEGTSDDSVAIPAQSSPAAVVAXGVPVLPPPPPPAKRLCVAPPTGVEHRAPPPDPPTSLSLSPPGAAAAAISASTVVGGSSAARAEEEAVAREKARMEQDPWLMAMMRQMITEEVQRQVSVVYSLVASSAAMAAQTGNAGGVGRKGPDGRPSNGQD

SEQ ID NO: 5939 - protein, 297 aa, Oryza sativa Japonica Group
MGAPKQKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSYKTAIANYIEEQYWPPADFDHVLSSKLNDLTASGKLIKVNRKYRIAPSSSLSEGRSSKVVLLEDIKKEPTKLDREDVAVLTKSQIDAELARMRTMTAEEAAAAAARAVAEAEAIMAEAEAAVREAEAAEADAVAAQAFAEAAMATFKNRSSAKLIIRA

SEQ ID NO: 5940 - protein, 83 aa, Nicotiana tabacum
RPFSVAEVEALVEAVEHLGTGRWRDVKMRAFDNADHRTYVDLKDKWKTLVHTASIAPQQRRGEPVPQDLLDRVLAAHAYWSQQ

SEQ ID NO: 5941 - protein, 286 aa, Arabidopsis thaliana
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 5942 - protein, 340 aa, Gossypium hirsutum
MDRRDAMALSGSASYYMQQRGITGSGSGTQSGVHGSPGIHPLSSPNVQYQSSISATTMGATLPVEPLSGITPHNVNVGTPPAVQPGETVKRKRGRPRKYGPDGTVSLALTPASATHPGTITPIQKRGRGRPPGTGRKQQLSSLGELLSGSAGMGFTPHVITIAIGEDIATKLMSFSQQGPREVCILSANGAVSTVTLRKPSSSGGTVTYEGRFEILCLSGSYLLTSNTGSRNRTGGLSVSLASPDGRAIGGGVGGMLIAASPVQVIVGSFIWGGSKAKNKKGGQEGIKDSDDQMVDNLVAPPGISPSQNMTPSAPAGVWPGSRSMDMRNNSHVDIDLMRG

SEQ ID NO: 5943 - protein, 358 aa, Saccharomyces cerevisiae YJM789
MDATSRMEQPDVFVSKLYHLLQGNAYSNIIQWSTDGSKFVIWNPDQFTKVILERFFGIHTFAAFVKQLSKYNFQKAERPDCVEFSNIHFQKDNINSLSLVKAHQSAATPNVAAINNMNKQCTFHWDPFKVNSILSKAIGKPSFEKLVKNVDRLQGNLDELKSTNADSLRIIREINASLQTISYHQFHAYQTANFLQENFDAIKKVVCPDSCLQHQQRQPKRPKRYSLLLLIPNASELSETPLMRFAGVFEFMNCSLDTATQWYPQLHLEAYDLLFVTVSPNMQQEHLIYFKRLRNLLPSFPVIAIINRPVSPQDTSIAPSNYSRYYFHHFLQLGFSDILVSPFTPTQLITLLSKHLRT

SEQ ID NO: 5944 - protein, 329 aa, Glycine max
MDPKFIGKPLAMVDLDRDRMSERGSHHRRSHSDTSFRFPANFDELLLFDPSDLDISGLPSPLPLPSQGAGGVVPMSVVSEESGGRPRPSGASAGGHLRSLSVDSDFFDGLGSGVGGDERGAGNGGGERHSNSMEGSSTTSFEADSATMMDGMKKATAPDKLAELALTDPKIAKRMLANRQSAARSKERKIRYTSELEKKVQTLQTEATNLSAQLTMLQRDTTDLTAQNKELKLRLQAFEQEAQLREDLNEALKKELQRLRVQSACWGAMTGGNPSFGGIFNQLASQLAMQQLSNSVPHQHQTQHQPQVGMPPPPSGQKHPKFMDFNQQK

SEQ ID NO: 5945 - protein, 175 aa, Zea mays
MADAHHFNNISLGGRGGGHPGQFKLYSGGLAWKKQGGGKIIEVDKGDITNVAWMRIPKSYQLSVGTKEGLCYRFFGFREQDVSNLTNFIEKSTGITPEEKQLSVSGQNWGGIQINGNMLCFNVGSKEAFEVSLADVAQTQMQGKTDVVLEFHVDDTTGANEVCELPECVSVMVYV

SEQ ID NO: 5946 - protein, 764 aa, Populus trichocarpa
MEIFSSGEDLVIKTRKPYTITKQRERWTEEEHSRFLEALKLYGRAWQRIEEHIGTKTVVQIRSHAQKFFSKLEKEAVVKGVPIGQALDIDIPPPRPKRKPSNPYPRKIGVGPPASQVGAKDGKLLTSASFPCCKQVLGLEKEPLPEKLNGDERPTNAKENQDDNCSEVFSLLQEPHCSSVPSINKNSVPTLDILKKASPFREFVSSPKEGNHDASNQSSVTVELGANQKLDNSDVKQDNSTSEFSKSENFCSFSEKLFQQKKSDDFIGALRTDGMQAMQNYPRHVPVHVLDGSLGTCMQTPPSDFSFQESMFHPIGEIPACPNLYSHPAASKTTDHPNISPRSSMHQSFPSFPPPFTPTHHNQDDYRSFLHISSTFSSLVVSSLLQNPAAHAAASFASTFWPYGNVESSADSPACAQGGFQSRQLNSAPSMAAIVAATVAAATAWWTAHGLLPMCAPLHTSFACPPASATAIQSVDTGQVSATKTERKETAENPSLQGQIQGPEHTEALQAQNSASKSPKITSSDSEESGGPKLNTGPEVIDHELTTKPHEVQDSSKTKSRKLIDRSSCGSNTPSSSEIETDALEKAEKGTEEPKEDDANHPASESSSRHSRSSSSMNDSWKEVSEEGRLAFQALFAREVLPQSFSPPHDLKSKMHQNEDAGEKKDADEKDGDASLINLNSKTWECCSGHQEGEKNALSRCENYGEEELLTIGLGHGKLKVRRTGFKPYKRCSLEAKESRTGTGSGQGEEKGPKRLRLEGEASV

SEQ ID NO: 5947 - protein, 301 aa, Lotus japonicus
MSKFKKQPASRRLRPQPLPEFKMGRKLLVIYDDPHATESSDDEYQSVPTEKKKLGKIKRCITEIPLPPLVPVISGSAETSSFAEKRINMSSKNVEGHNKKRVSTQNPSTSRQPSCKLRGVRLRKSGKWGAEIHSTFLKGGRSWLGTYNTAEEASQAYESTRLEIEAMTKARVPNNGSSDKGPASNSSSADATVAEGSASEKPSAEANDMVAELAGLEIPDLSLLNLPPTPPAAAAVVPIGSKPNPVLDIDFLADYAGQGFDDDTNLGGGLEDIPIFGVDNNEPSQLLDFNFGDFDSDGFAG

SEQ ID NO: 5948 - protein, 254 aa, Zea mays
EFGSRFTSDDERDGMVGVPGVSGNIFQEIDGRQFDSPILGSRKQKGGFGKGKGKANFATERERREQFNVKYGALRSLFPNPTKNDRASIVGDAIEYINELNRTVKELKILLEKKRNSADRRKILKLDEEAADDGESSSMQPVSDDQNNQMNGTIRSSWVQRRSKECDVDVRIVDDEINIKFTEKKRANSLLCAAKVLEEFHLELIHVVGGIIGDHHIFMFNTKIPKGSSVYACAVAKKLLEAVEIKKQAYNIFN

SEQ ID NO: 5949 - protein, 264 aa, Antirrhinum cornutum
HLPQVSSSLHSRAATFDLNGNEIQLHDMLSGHYLTTVSAPVLESTALFNNSFNHEVVNGLNRDPSPTFPTKQAAKKDRHSKIYTSQGPRDRRVRLSIGIARKFFDLQEMLGFDKPSKTLDWLLTKSKTAIKELVQSKSTKSNSSSPCDDCEEVVSVDSENVTDHSKGKAVLLKANNKCKEAMDLAKESRAKARARARERTKEKMCIKQLNEAIVRNHQFEASGNREAFVHPVFGFHQQNYGNTSNENWDQSNFASQSNQLYAIL

SEQ ID NO: 5950 - protein, 263 aa, Antirrhinum coulterianum
HLPQVSSSRAATSVVDLNGNEIQLHDMLSGHYLTTANAPVLDSTALFNNSFSHEVVNGLNRDPSPIFPTKQAAKKDRHSKIYTSQGPRDRRVRLSIGIARKFFDLQEMLGFDKPSKTLDWLLTKSKTAIKELVQSKSTKSNSSSPCDDCEEVVSVDSENVTDHSKGKSVLLKANNKCKEAMDLAKESRAKARARARERTKEKMYIKQLNEAIVRNHQFEVSGNREAFVHPVFGFHQQNYGNTSNENWDQSNFASQSNQLCAIL

SEQ ID NO: 5951 - protein, 250 aa, Arabidopsis lyrata subsp. petraea
HEGTLRSNIFLEDQETVSWIQYPPDEDPFETDDFSSHFFSTVDPLQRPTSETIKPKSGPDPPHVMVKPKACPDPPQVMPPPKFRLTNSSSGMRETEMEQYSVTTIGPSHCGSNPSQNDFDASMSQDRSKNIEEKLNPNASSSSGGSSGCSFGKDIKEMACGRSITTDRKRKHIMDTDESVSLSDAIGGNKSNQRSGSNRRSRAAEVHNLSERRRDRINERMKALQELIPHCSKTDKASILDGAIDYMKSL

SEQ ID NO: 5952 - protein, 518 aa, Physcomitrella patens subsp. patens
MTFDNDLSQDGSLQQFSELWGSSRFTQRQSSLGGDHAEHYLDPRNLRNQLDGAPLPKIEDEARKGKDHLRDSEDEDHHRHLLENEGSDTRACGPPTWLSSALLRQQADQSLDGTENCQSESEKWCPVCSANGRQSCVCNTRMHAGDGNATSFLNQNTYTHWLSMQGTGMHGPGHEHRPGPELDGKDNDFGVDRPQFRMATELNLSAAHGRDGQRFLELHPSLGGARYAGDYGRTDWDGARHKAEWEEIRNRALIVNHPLYPEMLMNHAACLRVGTPVDQLPSIEAQLAQAPNIIEKYRALHDQVDITEDEKVELDRFMTEYTALLGDFKDVLQHHVYTDVAEAMIGCWELEQALHALTGVSPGEGSGATMSDVDDDQDYDSDYAGTAYDQSMDYHDSGGYGPLVPTETERSLMERVRQELKHELKQGYRSKIEDVREEILRKRRAGKLPEGTTTVLKAWWQAHSKWPYPTEDEKEQLIQETGLELKQVNNWFINQRKRNWHSNPLVSSSDMKNKVRKR

SEQ ID NO: 5953 - protein, 592 aa, Zea mays
  misc_feature (16)..(16): Xaa can be any naturally occurring amino acid
  misc_feature (38)..(38): Xaa can be any naturally occurring amino acid
  misc_feature (48)..(48): Xaa can be any naturally occurring amino acid
  misc_feature (117)..(117): Xaa can be any naturally occurring amino acid
  misc_feature (131)..(131): Xaa can be any naturally occurring amino acid
  misc_feature (147)..(147): Xaa can be any naturally occurring amino acid
  misc_feature (213)..(213): Xaa can be any naturally occurring amino acid
  misc_feature (334)..(334): Xaa can be any naturally occurring amino acid
MSSAAGGYGGGGGRGXGAEPHGHADFLLHHHATARRGXQLYHVPQHSXRREKLRFPQDDAPPHALRFRPAAARRGRWPGRRLRRHRAFYSYASSSTSSYSPHSPTLAQAQLVVAHGXLAPPLSSQIPTQNXALSLSSSSSNPPPPAXRSRGGLTPRPFGPFTGYAAVLGRSRFLLPAEKLLEEICDVGGAASRVDRSASDEGLLDADPDGIHXITKWTGADRVANDAGPISGAEQQWKKTRLISMMEEVCKRYRLYYQQVHTVINSFETVAGFSNAAPFAAMALRAMAKHFKCLKGMILSQLRNITKAPAGKEGLSKDIAMFGLAGGSAAALEXPRGAQAYAYPHNIWRPQRGLPERAVSVLRAWLFEHFLHPYPTDGDKQMLAKQTGLTRNQVSNWFINARVRLWKPMVEEIHNLEMRQVHKHPVLDKGQHVLHHQTQHSFESSGKPSDPSDSQLGQSSSITRNHNIPASQGFADELSEMSHSIQQGQVTFAYNGMSAPHHSLASSQHHQQAGPMSGIGGAGNGGVSLTLGLHQNNRVCIAEPLPASVPPNLAHRFGLEEVSDPYMMGSFGNQDRHFGKEIGGHLVHDFVG

SEQ ID NO: 5954 - protein, 342 aa, Zea mays
MAEHFNDWDLQAVVRSCGGVAHAGPPPEPADAATAPAAPRGDEAPERVPGGARATPAVSARRQERAPPPVALLCDLEYLDSDHKPFLLPVARPSPRPRVGGGGHGSEVMISFPAGAASTSGVQQRASSPRRKPGARTPRPKRSKKSQLKKVVREMPVADGSSSSPDPWAWRKYGQKPIKGSPYPRGYYKCSSMKGCTARKLVERSPAKPGVLIVTYMAEHCHPVPAQLNALAGTTRHKPSSGAATELHSAASSPSSHEQGQTVEKAAGLRERGIGNNETSNSTMAGEFGGEEIAAVDDEDEFWPAEMDLDELLAPVDGDFDFEHVIEEDGVLGRRRPQKICP

SEQ ID NO: 5955 - protein, 223 aa, Oryza sativa
  misc_feature (53)..(53): Xaa can be any naturally occurring amino acid
  misc_feature (91)..(91): Xaa can be any naturally occurring amino acid
MEVGNGKCGGGGAGCELCGGVAAVHCAADSAFLCLVCDDKVHGANFLASRHRXRRRLGVEVVDEEDDARSTASSSCVSTADSASSTAAAAXAVESEDVRRRGGRGRRAPRAEAVLEGWAKRMGLSSGAARRRAAAAGAALRAVGRGVAASRVPIRVAMAAALWSEVASSSSRRRRRPGAGQAALLLRLEASAHVPARLLLTVASWMARASTPPAAEEGWAECS

SEQ ID NO: 5956 - protein, 233 aa, Elaeis guineensis
MGRGRVQLKRIENEINRQVTFSKRRSGLLKKAHEISVLCDAEVAVVVFSTKGKLYEYSTDSSMEKILERYRQYSNAEKALAQGDPGPQGSWLHEFGELKSKVEALQKCQRHLMGEQLDSLALKELQQLEQRLESALRHIRSRKNQLLFDSIAELRRKEKSLQEQNCILEKRLVESSAGAQNEHPHCERQSQPRTSSSSPLPFLVTDSFPTLHVRSNQARGTSLPAWMLRHVSG

SEQ ID NO: 5957 - protein, 266 aa, Antirrhinum nuttallianum
HLPQVSSSLHSRAATSVIDLNGNEIQLHDMLSGHYLTTANAPVLDSTALFNNSFNHEVVNGLNRDPSPTFPTKQAAKKDRHSKIYTSQGPRDRRVRLSIGIARKFFDLQEMLGFDKPSKTLDWLLTKSKTAIKELVQSKSTKSNSSSPCDDCEEVVSVDSENVTDHSKGKSVLLKANNKCKEAMDLAKESRAKARARARERTKEKMCIKQLNEAIVRNHQFEVSGNREAFVHPVFGFHQQNYGNTSNENWDQSNFVSQSHQLCAIL

SEQ ID NO: 5958 - protein, 302 aa, Oryza sativa Indica Group
MGRHACSAAGVQQKLRKGLWSPEEDEKLYNHIYRYGVGCWSSVPKLAGRLQRCGKSCRLRWINYLRPDLKRGSFSQQEEDAIVGLHEILGNRWSQIASHLPGRTDNEIKNFWNSCLKKKLRQRGIDPSTHQPISTAAAAAAAALDTSTQDQKPPATADGFALKQQQQVFDPFPVIDSFGSGFDATGMPLYGHLGGKDAAGFVDYSSVLDVSENLGYGESSSNSSNWNCGVGAPEVNNALESEPLHWATESKVEPFVGYGEGDAMEHKFGLPCHGQQEQGMTHFDFDVSRSMVVGDFNFEYFR

SEQ ID NO: 5959 - protein, 266 aa, Antirrhinum ovatum
HLPQVSSSLHSRAATSVVDLNGNEIQLHDMLSGHYLTTANAPVLESTALFNNSFNHEVVNGLNRDPSPTFLTKQAVKKDRHSKIYTSQGPRDRRVRLSIGIARKFFDLQEMLGFDKPSKTLDWLLTKSKTAIKELVQSKSTKSNSSSPCDDCEEVVSVDSENVTDHSKGKSVLLKANNKCKEAMDLAKESRAKARARARERTKEKMCIKQLNEAIVRNHQFEVSGNREAFVHPVFGFHQQNYGNTSNENWDQSNFASQSNQLCAIL

SEQ ID NO: 5960 - protein, 407 aa, Physcomitrella patens subsp. patens
MVDDPATDPVVSWSAGNNSFIVWNPPDFAQELLPKYFKHNNFSSFVRQLNTYGFRKVDPDRWEFANEGFLRGRRDLLRSIHRRKPATHSQQSVQQQQQQQHQQSEQGPVGPCVEVGKFGLEGEIERLKRDKNVLMMELVRLRQQQQNTERDLQAMGQRLLTTENRQQHMMSFLAKAMQNPSFLAQLMQQSENKRLAATVRKKRRLPKQDSSGDDSANSDSPADNQIVAFHSNGNADSNGARAMIMQFFNSTDAASSPSLDSGPLEALFRDLGSAPSGTDVGTLASRQSGVTLTEMNIPGLGDSLPGPVIRSGEIKPDGLSGESMEFNADGGRAPSEGEEVISNLGSPAVSAANDIFWEQFLKTDGDEIVEDSVEVLAGEDVGEVKNWWSKKPSVEQLSVQMGQLAPG

SEQ ID NO: 5961 - protein, 225 aa, Nicotiana tabacum
MRRGRAAAAPAPVTGEPNGSGGSKEIRFRGVRKRPWGRFAAEIRDPWKKTRVWLGTFDSAEDAARAYDAAARALRGPKAKTNFPLPYAHHHQFNQGHNPNNDPFVDSRFYPQDNPIISQRPTSSSMSSTVESFSGPRPPPAPRQQTTASSRKYTRSPPVVPDDCHSDCDSSSSVVDHGDCEKENDNDNDNIASSSFRKPLLFDLNLPPPMDDAGADDLHCTALCL

SEQ ID NO: 5962 - protein, 164 aa, Glycine max
DRQCALAEIWAILTVVCETHSLPLAQTWVPCKHRSVLAHGGGHKKSCSSFDGCCMGQVCMSITEVAFYVIDAHTWGFHEACVEHHLQQGQGVAGRAFLSHNMCFCGNIAQFCKTEYPLVHYALMFGLTSCFAVCLQSSHTGNDDYVPDRFRPPGATDFNEQIDC

SEQ ID NO: 5963 - protein, 611 aa, Gibberella zeae PH-1
MPSILNDDDKDTVKRFIPKQSNKIQAVGVARLYVAYPNRSKWTYTGIQGAVALVNDLVGNTYWIKMVDISPTNRGVIWDQEIFDTWNYNQDRTFFHTFELEECLAGLSFVDEKEAKQFKKKMDEREKNASRATKATPFGGGAQPSHKHGLLGGLFSHRHSTHHPTGPTPPESPRMPANSIQHHIINSTPNLNGHRQSEFSLLDAFDPLWREHFGADLQDKGLTDDFIKENQEFIVDFLREEQQKASQPHSTPPPPPAPASPANGNDGRSSRAPPPPPPPPAAGRSQDGPPAPPAPRKGGPPPPPAPRRSGKAETAPERAPSPPRPKFGVPPPLAEAGKFAHSEPPRAVSAAPNPGPPPPPRPAKTPIDSTKNENHRFGVPPPFPGSRVPPPTPSRGSVPPPPPPRSEPPAALPPPLPPKVPTSSAPPLPPPSTRPIPPPPAASSHPPAPPPLPPTTNGAPPPPPPPPPPPGGPAAPPPPPPPMPPTSGAPPPPPPPPPGGPGAPPPPPPPMPPGSGAPAPPVTGDPSRSAVLAGIQQAGGIHSLKKVDRSQIRDRSGAQVGGSDVGGNSATASAVSASGGGGGMADALAAALQKRKEKVSKSDDESDNDDW

SEQ ID NO: 5964 - protein, 359 aa, Vitis vinifera
MSPPLLGVGEEEGQSNVTILASSASMESVCQISSGLKERNYMGLSECSSVDSSAISTDSDGNKSSLNLKATELRLGLPGSLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAQGCGEMQEQEL

SEQ ID NO: 5965 - protein, 246 aa, Petunia x hybrida
MGRGRVQMKRIENKINRQVTFSKRRSGLLKKAHEISVLCDAEVGLIVFSTKGKLFEYATDSCMERILERYERYSYAERQLVSTDHSSPGSWNLEHAKLKARIEVVQRNQRHYMGEDLDSLSMKDLQNLEQQLDSSLKHIRSRKNQLMHESISELQKKDKSLQEQNNLLSKKVKEREKELAQQTQWEQQNNHHEINSSSSFVLPQPLDSPHLGEAYQSTVDNGEVEGASQQQPANTMPPWMLRHLNG

SEQ ID NO: 5966 - protein, 366 aa, Zea mays
MDAAQWHQGPLGLGKPMEEMLMAGNAANPNPPPAAAPSAPGAQTQSQGGGAPPPAAGAAAPSAGATGGAPGTERRARPQKEKALNCPRCNSTNTKFCYYNNYSLQQPRYFCKTCRRYWTEGGSLRNVPVGGGSRKNKRSSSSAASSTSAAMSGTVSVKNPKLVHEGAHHDLNLAFPHHNNGRALQPPEFPSSFPSLESSSVCYPGPAMLGNGAAGRGMGALSAMELLRSTGCYVPLQHVQLGMPAEYAAPAGFTLGEFRIPPPPPPQSQSVLGFSLDTHGTGGYSAGGLQESAVGRMLFPFEDLKPAVTTAGGGASNDGADHRQNDHRKDQAAGDGSSVTGGHETPGFWSNSLIGNGSSNGGGGPW

SEQ ID NO: 5967 - protein, 394 aa, Oryza sativa Japonica Group
MDGRESTVASGSNFSSFYVQHRGIGVPGGSGHPAGLHGPPPGGYRQHLDAVSAGYPFQPPHIGGSHIGQGYHHVDASAPVAQHGSGGGGGGMDIGMGVEMSADAKGDQGSGAGQDEPVKKKRGRPRKYKPDGAVTLGLSPSSSTPHSSTSAMGTMVTTPGSGFGSGAGSGGSGSGALTEKRGRGRPPGSGKMQQLASLGKWFLGSVGTGFTPHVIIISPGEDVAARIMSFSQQGPRAVCIISATGAVSTATLHQDSNSGGVVTYEGRFEILCLSGSYLVIEEGGSRTRSGGLCIALCGPDHRVIGGSVGGVLTAAGTVQVIVGSFMYGGTKKNKAKAEQETENNEEPIGGEEETPTMALPDHNMPHHTMGGWSAGLMRQMDSRTPNIDINSIRE

SEQ ID NO: 5968 - protein, 488 aa, Cycas revoluta
SRALWLDLPFRQAEAIGRSKPPEVAQPVKKSRRGPRSRSSQYRGVTFYRRTGRWESHIWDCGKQVYLGGFDTAHAAARAYDRAAIKFRGPDADINFSLSEYDEDLKQMSNLTKDEFVHILRRQSTGFSRGSSKYRGVTLHKCGRWEARMGQFLGKKYIYLGLFDNEIEAARAYDKAAIKCNGREAVTNFDPSIYESDLGEGESGSSYHNLDLSLGTSAPIVGTSLEDMSAGLKSKATVSSLIEPGWKRACHAKDVMEDGSHQNRFDSLYSSGQLGESSAAQSAKTLSCQRTNPGGGDRFGRDMPLVFRPQGQVLPSNSEKMQLNDISTYNASRPPPRTTDDNIHLLLDHGALQSKVHPLSFPNYEASNFDERLKEQRVGAFSPLSFLPMERQLGWASKLYTNGSSAPVFVTAASSGFSPQIVPTAIPSSDLLQKTGFHSTAFLFGAQRSTKPLFQTQNSELGIGNGAKSTELFLSLTLNSLDEMLDST

SEQ ID NO: 5969 - protein, 388 aa, Cycas revoluta
MAEPGLFRSALEQINSDENYGFKDFQALSLSMSSGSQSNSATTFPQPASPDRSTVGTRKRCAENREVVPRKSIDSFGQRTSQYRGVTRHLWTGRYEAHLWDNSCRKEGQTRKGRQVYLGGYDKEEKAARSYDLAALKYWGPSTHTNFPLSTYEKEIEEMKTMTRLEYVAHLRRKSSGFSRGASAYRGVTRHHQHGRWQSRIGRVAGNKDLYLGTFSTQEEAAEAYDIAAIKFRGINAVTNFDINRYDVKRICASSTLLIADLFMNKKDSSECPHVNAHPDVMTSSSIISTIKDSNGAPKENDWEVVLHARHPGVNRQPQHQGQHSPDHQNPNCYPDQMFNNNDCLHSAVLHDLIGLDASTADQMSSTSLLMTPPWEARAIRSARTRTA

SEQ ID NO: 5970 - protein, 292 aa, Oryza sativa Japonica Group
MADASSRTDTSIVVDNDDKNHQLENGHSGAVMASNSSDRSDRSDKLMDQKTIRRLAQNREAARKSRLRKKAYVQQLESSKLKLAQLEQELQKARQQGIFISSSGDQTHAMSGNGALTFDLEYTRWLEEQNKQINELRTAVNAHASDSDLRLIVDGIMAHYDEVFKVKGVAAKADVFHILSGMWKTPAERCFLWLGGFRPSELLKLLANHLEPLTEQQLLGLNNLQESSQQAEDALSQGMEALQQSLADTLAGSLGSSGSSGNVANYMGQMAMAMGKLGTLENFLCQASIFTF

SEQ ID NO: 5971 - protein, 219 aa, Triticum aestivum
MAGDRCKGAIAGCELCGGVAAVHCAADSAFLCVPCDAKVHGANFLASRHLRRRLVHAAADEDAGSAGSGSGSESSSSSSCVSTADSCAAASAATRAAGRRRAGCKHRRARAEVVLEGWAKRMGLAAGTARRRAARAAGALRALGRGVSASRVPLRVAMAAALWSEVAGSGCAEAALLRRLEASSHVPARLVVTVASWMARTAVRAPAPAPAEEGWAECS

SEQ ID NO: 5972 - protein, 441 aa, Zea mays
MCDFFWLSPADLGDPLGRRPGEPAASTATPPPTAGGPLLLPRPSARRAPHHLPEEEALLLLQARLNFGGDDHDEARSQLQSQQQLVHSSSGMVELMLGSNGSGGCACDHAAALCPHHHPEAEELIPRPTSGPQQQLCASTRSSFVERRDDDAPVLQEHVLDMAMAPHRPHSSAVKRRKSQTKKVVCIPAPVAAPPGVGGRPSTSGEVVPSDLWAWRKYGQKPIKGSPYPRGYYRCSSSKACSARKQVERSRTDPSMLVVTYTSDHNHPWPTQRNALAGSTRPASSSSSSARGHHGHNHRHHPSAAAVPDTAPAAHRHASNVAVADNATTPGSIISASVHRQLLKQEVVDMDNSKPAEDAAADHDLGFGMFADMDGALDVLCAPDFHPKKQQQQATAQQLEKLPEEEGTQLLLGPDPFSFGFLDWVGASFGVGERAADDGGQ

SEQ ID NO: 5973 - protein, 496 aa, Ginkgo biloba
  misc_feature (422)..(422): Xaa can be any naturally occurring amino acid
MLVGLSTNICREGARFETTGRPNPVTEPVQPVKKSRRGPRSRSSQYRGVTFYRRTGRWESHIWDCGMQVYLGGFDTAHAAARAYDRAAIKFRGMDADINFSLSDYEEDLRQMSNLTKEEFVHILRRQSTGFSRGSSKFRGVTLHKCGRWEARMGQFLGKKYIYLGLFDSEVDAARAYDKAAIRCNGREAVTNFEPSSYGSEVLTEGETVGNNHNLDLCLGSSAPIYGTLVSDDNKTTGFKSKSNSSNLSEEPDWKKARVVNTRTEDCSQQTPLDALYSGQFNVSSSLPGDKILPSPRPKAEAQKNFGKDMPFMCFPRGQIKSSDSDKQQAQSNMIKYNLLRHPRAMDDNTNLSSEQASLWTTGIHPANFKVPNLGDNMREQRGGEGCGSFSLPVEAPQSGWAWQLYSTRPAAPVFSSAASSXFSPQIVSAAVPSSDWLQKSGFRFMDQSAGAKLSANPAFQKQNSQLPTPLDIIGSGTKPSDHFLSLTSNLPVKKL

SEQ ID NO: 5974 - protein, 266 aa, Antirrhinum subcordatum
HLPQVSSSLHSRAATSVVDLNGNEIQLHDMLSGHYLTTANAPVLESTALFNNSFNHEVVNGLNRDPSPTFPTKQAVKKDRHSKIYTSQGPRDRRVRLSIGIARKFFDLQEMLGFDKPSKTLDWLLTKSKTAIKELVQSKSTKSNSSSPCDDCEEVVSVGSENVTDHSKGKSVLLKANNKCKEAMDLAKESRAKARARARERTKEKMCIKQLNEAIVRNHQFEVSGNREAFVHPVFGFHQQNYGNTSNENWDQSNFASQSNQLCAIL

SEQ ID NO: 5975 - protein, 511 aa, Ginkgo biloba
MYYDHNGAAGFDRDNPRLNINQLPLTHCRRMDVPPSYHAFGDNNNISSQQTYETHIHQESGLNQPNLYHVAFQQNSKESMFADCSLQLPPGTGMIENATNMVGISAIKTWLRQYPTAAASDKPPTTEPSGSPADKEGIESYGDLQSQALTLSMSPGSQSSSVTMPQSTSTECVAVETRKRGPGSKSGSRHPVPRKSIDTFGQRTSQYRGVTRHRWTGRYEAHLWDNSCKKEGQTRKGRQVYLGGYDMEEKAARSYDLAALKYWGPSTHINFPISTYQNELEEMKNMTRQEYVANLRRKSSGFSRGASMYRGVPRHHQHGRWQARIGRVAGNKDLYLGTFSTQEEAAEAYDIAAIKFRGINAVTNFDISKYDVKRITSSNTLLVGELAKRNKELEPSEPSEDHHSNSNNLLIGQDNDNRIITAQICSGSGKENDHDAQKIDQDWQIVVGQHEHHSNSDQKSSQAFNDQMQSGHLAALHNLIGIGCINNTGGMLESNRLLTDIPDRHHFSTIE

SEQ ID NO: 5976 - protein, 611 aa, Oryza sativa Japonica Group
MAMVEQEGCVENRQPLAASSSSVSDGSSYGGGGGGLAQMSPPVRKFFARFPSVGILLWEGSRKADKRANKESKGWLDTRGVTQSLLLIGLNLSQQDETLRKAVEAYKAECFPYRTEVQCLHRWQKVLNPELIKGPWTQEVCHVADFALMEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 5977 - protein, 212 aa, Brassica napus
  misc_feature (75)..(75): Xaa can be any naturally occurring amino acid
  misc_feature (84)..(84): Xaa can be any naturally occurring amino acid
  misc_feature (145)..(145): Xaa can be any naturally occurring amino acid
VHECLDVGIKALYRQRKSCYGYHTWKHETIYKRRRSPDRSSVVTSDGGLSNGSVSKLPEKRKSGSYCNSSVILSXLLWFSIIFXISGAVKLSIKSFRIPELFIEVPETATVGSLKVHCNVHLLSFSGTCLALLCVDIKVLIVIFXLFWLQRTVMEAVSVLLSGGIRVGVLVHGKKVRDDKRTLSQTGISFEENLSNLGFTLEPGGTSHGPIP

SEQ ID NO: 5978 - protein, 480 aa, Gnetum parvifolium
  misc_feature (430)..(430): Xaa can be any naturally occurring amino acid
  misc_feature (437)..(437): Xaa can be any naturally occurring amino acid
  misc_feature (442)..(442): Xaa can be any naturally occurring amino acid
  misc_feature (454)..(454): Xaa can be any naturally occurring amino acid
AARLPPAWMDIDPGFQAKTVVTELVSQPGAAKKSRRGPRSKSSQYRGVTFYRRTGRWESHIWDCGKQVYLGGFDTAHAAARAYDRAAIKFRGADADINFNYSDYEDDMKQMSHLTKEEFVHILRRQSTGFSRGSSKFRGVTLHKCGRWEARMGQFLGKKYIYLGLFDTEIEAARAYDRAAIRCNGREAVTNFEPSSYEDELLAEGGVDSVGGSASGGNSNVDHNLDLHLGMSSGGARGLPSNDYSSTNVSTKPKQQPTCINFSDNPEWKKARLHYPRADDSVHQTHFGQIFDPQPLVKFQKILSFGGLDSEAEDQRLIMECNLGPMANGKSQNQNQNQDRSGRSLLSWLAGSEQQQQQQSWQLQGSRPTGATATVFSFAASSGFSPQMLSASPASSFPSHHPERLSHHLVTAATPNLIGGSAPAANDSAXFYQKGSXAPTAXRSREYTATTDNXLSLSSDSSRSKSKTDLLLCDLQLKRL

SEQ ID NO: 5979 - protein, 571 aa, Coccidioides immitis RS
MESFENIYLDLSKQPGKCKLAESGLGWKPSGGGDTFTLDKSNIGAAQWSRAAKGYELKILPRAGGVIQLDGFDQEDFERTSKAFKLWYGINLENREHALRGWNWGKADFGKAELSFNVQNRPAFEIPYSEITNTNLAGRNEVAVEFSLSTDNGSHGVNGQPERTKNYGKKAGAGKDELVEMRFYIPGTAVKKDQADGDDKSVDGEEPEELNAANLFYETLMEKAEIGEVAGDTFATFPDVLHLTPRGRFDIDMYENSLRLRGKTYDYKIQYQSIKKFFLLPKNDDTHTLITIGLDPPLRQGQTRYPFLVMQLKLDDEYNLDLNMTDELLQTRYKDKLQAHYEEPIHQVITKVFRGLSGKKVIMPSKDFTSHHNHRGIKCSIKANEGLLFCLDKSFMFVPKPATYVQIENISVITMSRVGGAVSASRTFDITMTLKGGGEHQFSNINREEQQPLELFFKAKNIRFKNEMAEDTSALIAAALDNDELMGSSDEEVDGGHRGSADEDEESVDEDFQAESESDVAEEYDSAHESSGSGSGSDSDAEMDDAEDEGLDEDLDEQEEERPKKKSKIDK

SEQ ID NO: 5980 - protein, 266 aa, Antirrhinum vexillocalyculatum
HLPQVSSSLHSRAATSVVDLNGNEIHLHDMLSGHYLTTANAPVLESTALFNNSFSHEVVNGLNRDPSPTFPTKQAAKKDRHSKIYTSQGPRDRRVRLSIGIARKFFDLQEMLGFDKPSKTLDWLLTKSKTAIKELVQSKSTKSNSSSPCDDCEEVVSVDYENVTDHSKGKSVLLKANNKCKEAMDLAKESRAKARARARERTKEKMCIKQLNEAIVRNHQFEVSGNREAFVHPVFGFHQQNYGNTSNENWDQSNFASQSNQLCAIL

SEQ ID NO: 5981 - protein, 205 aa, Brassica oleracea var. botrytis
VLCDADVALIIFSSTGKLFEFCSSSMREVLERHNLQSKNLEKLDQPSLELQLVENSDHALLSKEIAGKSHRLRQMRGEELQGLNIEELQQLEKALESGLTRVIETKSEKIMNEISYLQRKGMQLMDVNKRLRQQGTQLTEENERLGQQIYNNVHERYGGGESENTAVYEEGHSSESITNAGNSTGAPVDSESSDISLRLGLPYGG

SEQ ID NO: 5982 - protein, 266 aa, Mohavea confertiflora
HLPQVSSSLHSRAATSVVDLNGNEIQLHDMLSGHYLTTANAPVLESTALFNNSFNHEVVNGLNRDPSPTFPTKQAAKKDRHSKIYTSQGPRDRRVRLSIGIARKFFDLQEMLGFDKPSKTLDWLLTKSKTAIKELVQSKSTKSNSSSPCDDYEEVVSVDSENVTDHSKGKSVLLKANNKCKEAMDLAKESRAKARARARERTKEKMCIKQLNEAIVRNHQFEVSGNREAFVHPVFGFHQQNYGNTSNENWDQSNFASQSNQLCAIL

SEQ ID NO: 5983 - protein, 387 aa, Hyphomonas neptunium ATCC 15444
MKKTLLCATAAAALATVGATAHAEDGWYGRADAQYTFDGILDHDGATDVNGTIAGDSSATENGGLGIGLGYGFANGLRLETVLGNRNGGIDVPTAINGVLPGTANASGHVSVTDLMVNGLYDFNKGGTIVPYIGLGVGGARVDAKASNRVLVDGDDSHALNGFSDKATGIAYQGLLGVGFKLSERLTMDVGYKYFTVEDLDFAGKHGGPGYDANYQDHSATLGLRYSFAAPPAPPPPPPPPPPPPPPPPPPPPPPPPPPEETTPPLAQQCSALSQEFVVYFEWDRSDVTSQAAAVIDQAVANIRSVEGCAAGSVTIVGHTDTSGNPDYNQRLSVRRADVVAAALSERGIANTLITQDGKGETALAKATQDGVREPLNRRSEVTIIVQ

SEQ ID NO: 5984 - protein, 491 aa, Glycine max
HASGWDETSNIPRPERVSQWKIEPALAPLALNPLPMPRPKRPRSNVVPSSPDSSVLTREASKVSVDPLPTSGFQRVLQGQELSTLRGNFAESNESDTAEKSGVWPPATDDEKIDVSTSRRYGSDSWMSMGRHEPTYPDLLSGFGAHGDHSSHPSFVDQNGPVANLSRKHLLDREGKHNVLSPWPGVPSSLSLNLLDSNLKGSAQGGDTAYQVRGNLRYSSAFGEYPVLHGHKVEHSHRSFLMPPPPSTQYESPRSRELLSKPISGKPCEVSKLKDSDCKLFGISLLSSRPIASEPSLSQRNVTSESVGHMHTASHHQRAIENDQKSEHSRGSKPADGLLIDDHEKVLQTSQPHLKDVQAKSHSGSARSCTKVHKKGIALGRSVDLTKFSDYGELITELDQLFEFGGELTSPQKDWLIVYTDNEGDMMLVGDDPWQEFVAMVRKIYIYPKEEIQKMSPGTLSSKNEENQSASEGAADAQEIECQLNHSSSDT

SEQ ID NO: 5985 - protein, 525 aa, Solanum chacoense
MASSGGNMNSFMNSFNSFSSSQFMTSSFSDLLSDNNDNNNKNWGFSDDRIKSFPMINSSSSPASPSSYLAFPHSLSPSMLLDSPVLFNNSNTLSSPTSGSFGNLNSKEGNSRSSEFSFQSRPATSSSIFQSSAPRNSLEDLMTRQQQTTEFSTAKTGVKSEVAPIQSFSQENMPNNPAPVHYCQPSQYVREQKAEDGYNWRKYGQKQVKGSENPRSYYKCTFPNCPTKKKVERNLDGHITEIVYKGSHNHPKPQSTRRSSSQSIQNLAYSNLDVTNQPNAFHENGQRDSFAVTDNSSASFGDEDVDQGSPISKSGENDENEPEAKRWKGDNENEVISSASRTVREPRIVVQTTSDIDILDDGYRWRKYGQKVVKGNPNPRSYYKCTFTGCPVRKHVERASHDLRAVITTYEGKHNHDVPAARGSGSYAMNRPPTGSNNNMPVVPRPTVLANHSNQGMNFNDTFFNTTQIQPPITLQMLQSSGSSSYSGFGNSSGSYMNQMQHTNNSKPISKEEPKDDLFFSSFLN

SEQ ID NO: 5986 - protein, 240 aa, Pinus strobus
MEHLNTAAAAQASSSLYGVNMAEYGDAGVSSMMGLITQHEPEQSENIMSTRMPSSFSSFHGHADCLLSAAMFQVSQGDHKLKPQPGMNQQLVSEQSIMSDSSMPSVKSKVCSGLRNQFEFHREQPGNCYTDQSSNMPISPIVTSLASQARGEARMIPSLDANSAHFNVDNEEHAIKSKILAHPQYPSLLGAYIDCQKIGAPPEAVARLDALTREHQDQQRRTASIGMDPELDQFMEAYCE

SEQ ID NO: 5987 - protein, 364 aa, Zea mays
QQQMYHQQQLHTHNQHLSSSRPGLPPEKQFLLHGAGGGGGGDAGLVLSTDAKPRLKWTPELHERFVEAVHQLGGPDKATPKTIMRLMGIPGLTLYHLKSHLQKYRLSKNLQAQAHTASAKNALVGCRTGADNALCQGSASPPPPPPPPHLNLDPPQINRSMHISEALQMQIEVQRRLHEQLEVQRHLQLRIEAQGKYLQSVLEKAQEALAKQSGGADETTTTQQQMLPDLISRATATRRGHVQQEHLHLQHHLGGDGSVDSCLTACEGSRCQRERDQDLLSIGLSSAPPPTPSRGYNDRGGGGSASCEEFLQFLDEPGRRGAGGGGGSSDEQQELDLSISGGRSNPRPRGSQSQRIDLNGSSWN

SEQ ID NO: 5988 - protein, 412 aa, Oryza sativa Japonica Group
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLAGKSTNHPSPSSCSRLRFYFYLHTCSFCFFSSAAAAAADDDDLVVGGDGGGGGGGGLPHCKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 5989 - protein, 318 aa, Physcomitrella patens subsp. patens
MARGCSHCGHNGHNSRTCPDRGVRLFGVRLTDGVMRKSVSMGNLSHYIGPNNPPSPPSHSESGAGGDGYVSDGLVQTSNNTRERKKGVPWTEEEHRLFLLGLQKLGKGDWRGISRNFVQTRTPTQVASHAQKYFIRQSNMNKRKRRSSLFDIVSETLSLGPNSMYPGIFYDANNPHGYVRPYMLPPTSMAVPIMSIGPVSLGASEQIPETSAVNFSGPNGAMGISYPFPMFSMMPRGYNRPVNSVDSKVLRPTAKLSTEPLNVGVNETKEMSQLNLGLPTPEPSQLTLKLLDQPSRSSSAFHVSTSSISSSGNAIGVV

SEQ ID NO: 5990 - protein, 360 aa, Oryza sativa Japonica Group
MLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 5991 - protein, 246 aa, Oryza sativa
  misc_feature (231)..(231): Xaa can be any naturally occurring amino acid
MRVDREMERGDEASVNRGWLELRLGVNGGGGVETVPVTAADSSASSEAGEADTVTPSQQQQQQQQGSPSSPAASSAPNKVFSCNFCMRKFFSSQALGGHQNAHKRERSAAKRTPSSSPYHLHHHRMMMAGAGLPLEAHAAFMRAALRVNPAGSAIHKQQQQHQPPPPITQDATAPRFHDGAAVAAAAAVTPWAPVAPLAYDEVLSSSASSWPGSFRFRTQPEPPPSSEQEXPPSEQSKKIDLSLRL

SEQ ID NO: 5992 - protein, 188 aa, Gnetum parvifolium
TRHRWTGRYEAHLWDNSCKKEGQSRKGRQVYLGGYDQEEKAARSYDLAALKYWGPTTHINFPLSMYTKQIDEMKHMTRQEFVAHLRRKSSGFSRGASMYRGVTRHHQHGRWQARIGRVAGNKDLYLGTFSTQEEAAEAYDIAAIKFRGLNAVTNFDITRYDVNLICASASLPSGHVAKRHLQSQPFNE

SEQ ID NO: 5993 - protein, 173 aa, Vitis vinifera
MGPDRLAELALIDPKRAKRILANRQSAARSKERKIRYTNELERKVQTLQTEATTLSAQVTMLQRDTTGLTAENKELKLRLQAMEQQASLREALNEALREEVQRLKIATGQIPAVNGNSFNRGLPPQFSSHPQALHHFGAQQQQQQLHMPQSSTNNQSLNGQPQPSFLDFNQRV

SEQ ID NO: 5994 - protein, 459 aa, Schizosaccharomyces pombe
MAEEKKEELFTSIGNAAQNVSTAEDREGNGVQEVESLCMECGKNGTTKLLLTVIPYFREVVLMSFECPHCGFKNAQVQHAETIQPEGTKITFHVEDKEDLNRTVVKSQEAIVSIPEIQLEIPGRLGQLTTIEGILSNVVDDLSKEQESRKESAPQLYDQINAFIEKVNSLRSGSVPFTITVDDITGNSWIEMKPGRDGDRWSQVSYKRTLEQNTKLGLVDTDQPEDVKTQTNNASNTLKHDATAVEVDPNEVHTFHATCPSCSHQCDTHMKLLDIPHFKEVIIMSTVCDRCGYRSNEVKTGGEIPPKGRKITLKVMDAEDLSRDILKSETASLKIPELGLDLFPGTLGGRFTTIEGLLAQVYDELYARVFSQETDSMTPEQVANWQQFLCNLTAAREGATQFTLILDDPLSQSYLQNYYAPDPDPNMTIEEYERSFQVNEELGLNDMKTENYEKDGGKK

SEQ ID NO: 5995 - protein, 438 aa, Zea mays
MAPKRPAAASGSASEASDAEADAGHHQPSSPSPSKTPPPPNPNPKSTAAGPTSAAEDSTAAGSGSEAAYDSDADHRTAPRNAASPSSKPRSTRPRSRSRSRSPDAASYSDGVASDADADPAAVDGADSADDGNASPLAPPRPSRAEAAAVKPISSRPMDPPRRSMVPSFSEQRSKRPRSVAVPSSVEHLKRPTRLWSLHDEIVILRGLATYRAKRGVLPGSTYDISKLHGRIRSELSVKVTTTQLGDKVRRLKQKYNLLASRGKSGRDPDLPSQHEQSVYEIGKKVWGGSANGGGSTGGDGYEIGGDSEEEHEFRESDEDVENGRDERARKNRRVMPIAMANGNGAGLGAVKANSRGKFDTEKGKDAYPYLWETVEDLSKEHPNGVAFKKAFESIEGPKARGMEEKLRKFRLTEIRHQLRRMELMKETVKMVLDALEG

SEQ ID NO: 5996 - protein, 716 aa, Zea mays
MAAAACAGAEAGRGCGGKDALFVELWKACAGPLSCVPPLGEKVYYLPQGHIEQVEASTNQLAEQQGTPLYNLPWKIPCKLMNIELKVEPDTDEVYAQLTLLPDKKQDENTSTTVEEEEVVVPPALPATNEGPHIHSFCKTLTASDTSTHGGFSVLRRHADECLPPLDMSQHPPNQELVAKDLHGAEWRFRHIFRGQPRRHLLQSGWSVFVSAKRLVAGDAFIFLRGENGELRVGVRRALRHQTTIPSSVISSHNMHLGVLATAWHAVNTDSMFTVYYKPRTSPAEFVVSRDRYYESLKRNYSIGMRFKMRFEGEEAAEQRFTGTIVGIGASDPSGWADSKWRSLKVRWDEPSSISRPERVSPWQIEPSVSPCHVNPLPVRFKRSRSSVNALPSDVSTVTREVTSKVMADSQQNSLTRALHNQGRTQLTVRYHDNSDVKTTQDLTVWSSGTEQQRNNIAAQTKLCLEGWTPTRSPEGYNQIFSAFKPLKDIHNPLGPFPSQISGTHSNSWDTADARYPVQQANYSMLPGTWSLRPHNSGFRMNQQNYLVMPEGANFTGKSAFTSLQDHGTDKCSTGCFGHIESSSHTDHASSSLIRPQPLVLGNGVQKSKGTSFKLFGIPLGSPEKSEPLVSPPSVAYDGKLQTSPSEKGNQLDVVEVDNCSHPSKTVKPLDGPQSDSITENNQPSPEATLNIQNKVQSSSTRSCKKVHHMLHLFPC

SEQ ID NO: 5997 - protein, 334 aa, Arabidopsis thaliana
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 5998 - protein, 462 aa, Vitis vinifera
MNHHSVLSAKQTESTKGFTQSYCAAVSPIHNLLNVELEVQPQKLCSKSGPYSSVSSDTDAQYPKCTFSRSSVFCTSLYLSSSSSTETHRPLGNLPFLPHPSMSYQSISAVHSTKTPFLSGDSSGLYDEGNSEDMMKGFLNLSSDASDESFHVMNCASDNITFSEQLELQFLSDELDIAIADNGENPRLDEIYEMPQDSSTPAMALGLTVNQNHQSVAPSTDASSGQPSPGAAAAHKPRMRWTPELHERFLEAVNKLEGAEKATPKGVLKLMNIEGLTIYHVKSHLQKYRLAKYMPERKEDKKASGSEEKKAASSNNESDGRRKGNIQITEALRLQMEVQKQLHEQLEVQRTLQLRIEEHARYLHKILEEQQKAGSALISPPSLSSPTSPHPDSERQPSSPSATTTLPQPAECKADSSSPPPSKHKAATETTDSEQQACSKRSRLESNPEPVSDEAVVENPSQ

SEQ ID NO: 5999 - protein, 251 aa, Arabidopsis thaliana
HEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSL

SEQ ID NO: 6000 - protein, 652 aa, Oryza sativa Japonica Group
MSARPPPPPRPRLALPPRSAAESLFTGAGDASPGPLTLASALFPSDPDGGGGGGGVMTSSSSSAAGATSFTQLLIGNLSAPPPPPPPPQQQQQREAARGGGVARAGPALSVAPPPTAGSVFTVPPGLSPSGLLDSPGLLFSPAMFDAFDVLDMFIPDKILPKRATRIKLDIYFVKTSPEGGFGMSHREALAQVTAQASHSPLRMFDHTEQPSFSAAPTSSEAMQHMNAAVNMTGISDMVMGPTNNENVAFQPAEASQRYQVNAPVDKPADDGYNWRKYGQKVVKGSDCPRSYYKCTHPNCPVKKKVEHAEDGQISEIIYKGKHNHQRPPNKRAKDGSSSAADQNEQSNDTVSGLSGIKRDQEAIYGMSEQLSGLSEGDDMDDGESRPHEADDKESDSKKRNIQISSQRTSAEAKIIVQTTSEVDLLDDGYRWRKYGQKVVKGNPHPRSYYKCTYAGCNVRKHIERASSDPKAVITTYEGKHNHEPPVGRGNNQNAGNAAPSSSAQQNMQNLSKANWGLTVQKRRITPSTDFLGTPVAEVAHWQILDACNSNSHTVPNVQEIDLLHGKLTVVPASVPFLAILICRICSCSEQLLSFLTPPLYEVSIINYYDLISLQVNHIMPCAYQYHIPFYRRSVTTRASGQAGVWIKERST

SEQ ID NO: 6001 - protein, 449 aa, Populus trichocarpa
MGSANSKVDKTEPLALCKERRKFIKQAIDSRYNLAAAHVSYINSLRNIGVALRRFAEAEVLIESSLSTTSATELDKSPSHSSYLSPSPSHNAEVSDSPLHFESPISPPVLNMSYMRAGGGGNAVTVKFNLNNSSDFVEDESLGFSMPPPPPPPFESGGSWDFFDPSDTGESFRFVGHGDLDMEFDDIGGWNEFRSERVGVEHSVVDAKGKWTEVGLDKNSRVHEETLKPGVEQNGVENSGNSITQNGSCNFIVEGTATSSRLRAVEGSSGQVLVGQMRHVEEGQNVNVSTLGQSGSKREKAVAVNNLSAEREDPSEFITHRAKDFLSSIKDIEHRFFRASESGKEVSRMLEANNIRVGYTEAKGGSSASAILVAVKFVCCRGKTALVSHEPMEHMTKVITWKRTASLRSSSSRNPLVTATKDDASDSGNDFVEEFCMIAGSHSSTLDRL

SEQ ID NO: 6002 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDGNSPHFNVDNEEYAIKSKILAHPQYPSLLGAYIDCQKIGAPPEAVARLDALTREYQNQQRRTVSIGMDPELDQFMEAYCE

SEQ ID NO: 6003 - protein, 240 aa, Pisum sativum
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGTMSLKELQSLEQQLDTALKLIRTRRNQLMYESISELQKKEKVIQEQNNMLAKKIKEKEKIAAEQQVQWEHPNHHGVNPNYLLHQQLPSLNMGGNYREEAPEMGRNELDLTLEPLYTCHLGCF

SEQ ID NO: 6004 - protein, 251 aa, Arabidopsis thaliana
HEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINDTDESVSLSDAIGNKSNQRSGSNRRSRAAEVHNLSERRRRDRINERMKALQELIPHCSKTDKASILDEAIDYLKSL

SEQ ID NO: 6005 - protein, 244 aa, Pinus strobus
MEHLNAAAAQASSSLYGVSMAEYGDVGVSSMMALMTQHEPHESESTMTTSMPSSFSSFHGHAECLLSAAMFQASQGDHKLKRQPGMDQLVSEQAVMSDSSMPSVKTEGCSSIRNQFEIRREQSGNCYADQSSNAAPLVTSLASQTGGGAARMITSMEADSPHFNEGDAIKSKILAHPQYPSLLGAYIDCQKIGAPPEVAARLDALTREYENQQHRSTLSIGMDPELDQFMEAYCEMLTKYHEEL

SEQ ID NO: 6006 - protein, 217 aa, Zea mays
  misc_feature (124)..(124): Xaa can be any naturally occurring amino acid
  misc_feature (146)..(146): Xaa can be any naturally occurring amino acid
MSEPSSDTSCTSSCSSGPSTSTSPRAAPSAAAAAASGGGKKRPRSDDGGSSSSSAPAYRGVRMRAWGKWVSEIREPRKKSRIWLGTFPCPEMAARAHDAAALSVKGARAVLNFPGLARHLPRPXASLAPRDVQAAAARAALMHHSXRDGAAAHDEPEPERQPLEVAAELVFDELAPLWVEDVVELGPSADHPWPWTPCDGLDIAAGFHPLPLLWDDY

SEQ ID NO: 6007 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 6008 - protein, 290 aa, Pinus strobus
MEHMNTSAQSSSSLYGVHMVEYGGDVGVGSMMALMTEHQPESESIMTSIPIPSSYSSYSHGHGHGHGHGHGHGHGHGHSECLLSAAAMFQTSRPCQGSNKFEPANAHIGGGGGGGAGHFVMEQFIPEQAVISDSSISSVKTEVCSGSGGQFELIRRKEEGRCHARGYPEPSFVVTPLVSSLPPQQQEGRMVTSLAVDMDSSCSCKPNEADAMRAKIIAHVHYPRLVAAYIDCQKVGAPPEVVSELDDLSHKCQTQQCVPTISVGADPELDQFMEAYCEMFIKYQEELTKP

SEQ ID NO: 6009 - protein, 333 aa, Triticum aestivum
MAAAIDMYKYNTSTHQIGSAASASDQELMKALEPFITIASSSPYPYQYYSSPSMTQDSYTATPSSSYASFATSPLPTTAPTSPSFSQLPPLYSSQYSTASGMNGSMGLAQLGPAQIQQIQAQFFVQQQQQQRGLAGSFLGPRAQPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSAEAEPESPKCSASTEGEDSASAGSPPPPTPPVPEMEKLDFTEAPWDESETFHLRKYPSVEIDWDSILS

SEQ ID NO: 6010 - protein, 199 aa, Physcomitrella patens subsp. patens
MSERNRRSDTSSSQYRGVRMRRWGKWVSEIRDPIMKKRIWLGSFRTEAEAAHAFDAAALMCLRNPMSQLNFPHYSYIIPSGSAGCFSTREIQAAAAATAAASAGRSFSYNGFTQSSTSASSDSDDAQEIEDITYDEHQRYTHPSVPSYSCSSYARSWSNFDEDIDLVSEMARGMLMQPPAPDDDDDGDYNYPGPLYLWN

SEQ ID NO: 6011 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 6012 - protein, 328 aa, Triticum aestivum
MAAAIDMYKYNTSTHQIGSAASASDQELMKALEPFITIASSSSSHYPYHYYSSPSMTQDSYMATPSSSSYASSFAASPLPTTAPASPSFSQLPPLYSSQYAVNGSMGLAQLGPAQIQQIQAQFFVQQQQQQQRGLAGGSFLGPRALPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSEPESPKCSASTEGEDSASAGSTPPVPEMEKLDFTEAPWDESETFHLRKYPSVEIDWDSILS

SEQ ID NO: 6013 - protein, 333 aa, Triticum aestivum
MAAAIDMYKYNTSTHQIGSAASASDQELMKALEPFITIASSSSSHYPYQYYSSPSMTQNSYMATPSSSYASSFAVSPLPTTAPASPSFSQLPPLYSSQYAASGMNGSMGLAQLGPAQIQQIQAQFFVQQQQQQRGLAGGSFLGPRAQPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSEPESPKCSASTEGEDSASAGSPPPPTPPVPEMEKLDFTEAPWDESETFHLRKYPSVEIDWDSILS

SEQ ID NO: 6014 - protein, 958 aa, Oryza sativa Japonica Group
MESLLDLRRLLKKEKSAMNQKGDDLSMGKRLKALLTIVMRTTGPTRRSTKGNWTPEEDAILSRAVQTYNGKNWKKIAECFPDRTDVQCLHRWQKVLNPELVKGPWSKEEDEIIVQMVNKLGPKKWSTIAQALPGRIGKQCRERWYNHLNPGINKEAWTQEEEITLIHAHRMYGNKWAELTKFLPGRTDNSIKNHWNSSVKKKVNSYMSSGLLTQVSCLPLNEYSANCNSSPAMTQQNSEDSGCFAVREVENSSGCSQSSLAKVSCSQVHDTTVPLGCDLQVNANFDKNEAHDSQSSMGPQACYTSAEAVASALPAVHCHVSSSNLDPDQHLQEDFAQGLNLDMTIDEMPTVPSFADNQTVCSIENHERSLEPYDVAMEVPLSMLSSDSGAEQKLHFMSEADFNSPNCLKSELWQDISLQGLLSGPDAVEADSISRSNHQSDVYSSEADTHFLAPPYMPQTSNSSSVMGLADDQSPQMSVPPSLICSNAMTDDAPFDNRPGRKEMPLSQAEVVTQSSSSSGDAEMFANPGCSNDRHVPSSTMESIPECGDQQVTNAEEPEASLEKEPSLTQSVTAPDEQDKGALFYEPPRFPSLDVPFVSCDLVTSGDLQEFSPLGIRQLMHSTMNVCTPMRLWGSPTHDESTGVLLKSAAKSFICTPSILKKRHRDLLSPIPDKRIEKKYGTEKDRGVSDTSSTGIQTSCINATKDDALITTVLRIERSASSKSLEKKLVFSDENKENLGYTTEQTKDGQSAGNDEHMDEQTTGERSSATNVATNDDLSGNLQPAGILIEHSGDDPISPDYGKNTMNQKLNTNVKSLSVCKEGVCAKSKPTELIVEKSSPCINVDYEYVNILADTPGIKRGLESPSAWKSPWFVDMHFQGSYFTSPADSYDALGLMKQINVQTAAALVEAREVLASGGQCDNISSDKENTGNPDAKKEPGTTKLQTKIMVRGSELPLR

SEQ ID NO: 6015 - protein, 1041 aa, Arabidopsis thaliana
MNRHRLLSAATDECNKKLGQACSSSLSPVHNFLNVQPEHRKTPFIRSQSPDSPGQLWPKNSSQSTFSRSSTFCTNLYLSSSSTSETQKHLGNSLPFLPDPSSYTHSASGVESARSPSIFTEDLGNQCDGGNSGSLLKDFLNLSGDACSDGDFHDFGCSNDSYCLSDQMELQFLSDELELAITDRAETPRLDEIYETPLASNPVTRLSPSQSCVPGAMSVDVVSSHPSPGSAANQKSRMRWTPELHESFVKAVIKLEGPEKATPKAVKKLMNVEGLTIYHVKSHLQKYRLAKYMPEKKEEKRTDNSEEKKLALSKSEADEKKKGAIQLTEALRMQMEVQKQLHEQLEVQRVLQLRIEEHAKYLEKMLEEQRKTGRWISSSSQTVLSPSDDSIPDSQNMSKTKASSPQPPLPAENKASETEDDKCESPQKRRRLENIAESEDPKRSLSETCKLITDIEDVTAFTVRKESLILCLCVYRSLLIEKRKMLESGICKETFPKMVMEERSCHTANRVGDVQMGNGHKRGRSEDSSSNNVSIGVETDKQDMLSNKAQKKWVFGKCVNLSAVDAPCFKEMMTVDGGQMGLESSDCHDLNGWRLQDALEEVQDRVEKIKESWAITGCSILLDAWVDQKGRDLVTFVADCPAGLVYLISFDVSDFKDDVTALLSLVNGLVEEVGVRNVTQIIACSTSGWVGELGELFAGHDREVFWSVSVSHCFELMLVKISKIRSFGDIFDKVNNIWLFINNNPSVLNIFRDQCHGIDITVSSSEFEFVTPYLILESIFKAKKNLTAMFASSNWNNEQCIAISNLVSDSSFWETVESVLKCTSPLIHGLLLFSTANNQHLGYVYDTMDSIKESIAREFNHKPQFYKPLWDVIDDVWNKHLHNPLHAAGYFLNPTAFYSTNFHLDIEVVTGLISSLIHMVEDCHVQFKISTQIDMYRLGKDCFNEASQADQITGISPAEWWAHKASQYPELQSLAIKILSQTCEGASKYKLKRSLAEKLLLSEGMSNRERQHLDELVFVQYNLHLQSYKAKLSEEIDVYKD

SEQ ID NO: 6016 - protein, 216 aa, Arabis pumila
MSSFSAFSEMFGSDYESMISSVGDYSPTLATSCPKKPAGRKKFRETRHPVYRGVRQRNSGKWVSELREPNKKTRIWLGTFQTAEMAARAHDVAAIALRGRSACLNFADSVWRLRIPESACAKDIQKAAAEAALAFQNELMSDTATTDHGLDMEETLVEAIVTAEQIDTFYIDEETMFGMPSLMANMAEGMLLPLPSIQWINNYDVEGDADMPLWSY

SEQ ID NO: 6017 - protein, 65 aa, Oryza sativa
PVFLINFAEVNNTAQNFVHFTEEEEDLVFRMHRLVGNRWELIAGRIPGRTAKEVEMFWAVKHQNT

SEQ ID NO: 6018 - protein, 477 aa, Triticum aestivum
MYHHHLQQQQQQRGESEAAASVDQDSSMSNLTTSASASANPPPPPTPASNKRKRSLPGNPDPESEVVALSPATLMATNRFLCEICGKGFQRDQNLQLHRRGHNLPWKLKQRGSKEVVRKKVYICPEASCVHHDPSRALGDLTGIKKHFFRKHGEKKWKCDKCSKKYAVQSDWKAHSKICGTREYKCDCGTVFSRRDSFITHRAFCDALTEESNKAISGGGLPLPPIAHAQHHAMLYSPHDLMQQQQHQELAAFQDHHHHHQVMQQHCNFDVKPEMQPWPTMPYDDVHHPLLQPLCSATAQSSATSVPTPTQQQQLPAAAAHLSATALLQKAAQMGATIGGAGAGGAGVHYTQMAGSATSATGSATFGLGLSCLSNQQMMSLARTASQGRSGEEGGASGGANDGMTRDFLGLRAFSHRDILGLAGFDSSCMGAAVNTAGNNTNMAPCYEPQQQGQPQPQPPQQQQSSNEPWHGMGSHA

SEQ ID NO: 6019 - protein, 93 aa, Saccharomyces cerevisiae
MVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 6020 - protein, 343 aa, Glycine max
MELGIFRGTHIKIFCMCLPEGERGMALEAVVYPQPQDPFGHGIKDPSYNYNNLLEGGGGNWGYADFNLEKEDRTCVPFLANQTENYPYGEWNCSPSPPSMLPQLNIASNPQSSETSNTQNNLDSSVSTPARPKRRRTKSRKNKEEIENQRMTHIAVERNRRKQMNEYLSVLRSLMPESYVQRGDQASIIGGAINFVKELEQRLQFLGAQKEKEAKSDVLFSEFFSFPQYSTSASGGCDNSTAMSEQKSEAQSGIADIEVTMVESHANLKIRSKKRPKQLLKIASSLHGMRLTILHLNVTTTGEIVLYSLSVKVEEDCKLGSVDEIAAAVYQILDRIQQETISN

SEQ ID NO: 6021 - protein, 250 aa, Triticum aestivum
MFPAEASFAGAEAAMLPPFFVGSMWQSAPGGGAAALSEEDEVAAAAAAEAAHDRAVAATRNHREAEKRRRERIKSHLDRLRAVLACDPKIDKATLLAKAVERVRELKQRMDGVVGEAAAPASHLFPTEHDEIVVLASGGGAGGAAAVFEASVCCDDRSDLLPGLIDTLRALRLRTLRAEMATLGGRVRNVLVLARDAGGHADDDYSTSSEDGGADFLKEALRALVERQGAAAGDRPKRRRVADMNMQAAA

SEQ ID NO: 6022 - protein, 260 aa, Solanum lycopersicum
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRVQPSYNVV

SEQ ID NO: 6023 - protein, 183 aa, Eucalyptus grandis
MGRGRVELKRIENKINRQVTFAKRRNGLLKKAYELSVLCDAEVGLIIFSNRGKLYEFCSSSSMLKTLERYQKCNYGALEPNVSARESLELSCQQEYLRLKARYEGLQRTQRNLLGEELGQLCSKELESLERQLDGSLKQIRSRRTQYMLDQVTDLQHREQVVHEANRTLNQRLMEGYQVMRSS

SEQ ID NO: 6024 - DNA, 11722 bp, artificial Sequence
  pMON93039
cgcgcctgcctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgg

SEQ ID NO: 6025 - DNA, 9769 bp, Artificial Sequence
  pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 6026 - DNA, 8504 bp, Artificial Sequence
  pMON99053
aggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctggtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcg

SEQ ID NO: 6027 - protein, 427 aa, artificial Sequence
  Consensus Sequence
  misc_feature (1)..(23): Xaa can be any naturally occurring amino acid
  misc_feature (25)..(25): Xaa can be any naturally occurring amino acid
  misc_feature (27)..(34): Xaa can be any naturally occurring amino acid
  misc_feature (36)..(62): Xaa can be any naturally occurring amino acid
  misc_feature (64)..(128): Xaa can be any naturally occurring amino acid
  misc_feature (130)..(137): Xaa can be any naturally occurring amino acid
  misc_feature (139)..(169): Xaa can be any naturally occurring amino acid
  misc_feature (171)..(172): Xaa can be any naturally occurring amino acid
  misc_feature (175)..(175): Xaa can be any naturally occurring amino acid
  misc_feature (177)..(177): Xaa can be any naturally occurring amino acid
  misc_feature (180)..(181): Xaa can be any naturally occurring amino acid
  misc_feature (184)..(190): Xaa can be any naturally occurring amino acid
  misc_feature (192)..(209): Xaa can be any naturally occurring amino acid
  misc_feature (211)..(223): Xaa can be any naturally occurring amino acid
  misc_feature (225)..(226): Xaa can be any naturally occurring amino acid
  misc_feature (228)..(228): Xaa can be any naturally occurring amino acid
  misc_feature (231)..(231): Xaa can be any naturally occurring amino acid
  misc_feature (234)..(234): Xaa can be any naturally occurring amino acid
  misc_feature (254)..(254): Xaa can be any naturally occurring amino acid
  misc_feature (256)..(256): Xaa can be any naturally occurring amino acid
  misc_feature (266)..(266): Xaa can be any naturally occurring amino acid
  misc_feature (268)..(268): Xaa can be any naturally occurring amino acid
  misc_feature (273)..(273): Xaa can be any naturally occurring amino acid
  misc_feature (279)..(279): Xaa can be any naturally occurring amino acid
  misc_feature (285)..(427): Xaa can be any naturally occurring amino acid
XXXXXXXXXXXXXXXXXXXXXXXEXLXXXXXXXXQXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXGXXXXXXXXSXXXXXXXXXXXXXXXXXXXXXXXXXXXXXXXAXXSSXGXSGXXFGXXXXXXXSXXXXXXXXXXXXXXXXXXEXXXXXXXXXXXXXSXXRXGSXRRXRAAEVHNLSERRRRDRINEXMXALQELIPHCXKXDKASXLDEAIXYLKSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 6028 - protein, 661 aa, artificial Sequence
  Consensus Sequence
  misc_feature (1)..(439): Xaa can be any naturally occurring amino acid
  misc_feature (441)..(539): Xaa can be any naturally occurring amino acid
  misc_feature (541)..(552): Xaa can be any naturally occurring amino acid
  misc_feature (555)..(555): Xaa can be any naturally occurring amino acid
  misc_feature (560)..(560): Xaa can be any naturally occurring amino acid
  misc_feature (562)..(562): Xaa can be any naturally occurring amino acid
  misc_feature (566)..(566): Xaa can be any naturally occurring amino acid
  misc_feature (569)..(569): Xaa can be any naturally occurring amino acid
  misc_feature (573)..(573): Xaa can be any naturally occurring amino acid
  misc_feature (584)..(586): Xaa can be any naturally occurring amino acid
  misc_feature (588)..(591): Xaa can be any naturally occurring amino acid
  misc_feature (600)..(602): Xaa can be any naturally occurring amino acid
  misc_feature (611)..(611): Xaa can be any naturally occurring amino acid
  misc_feature (613)..(613): Xaa can be any naturally occurring amino acid
  misc_feature (620)..(620): Xaa can be any naturally occurring amino acid
  misc_feature (625)..(625): Xaa can be any naturally occurring amino acid
  misc_feature (628)..(628): Xaa can be any naturally occurring amino acid
  misc_feature (632)..(632): Xaa can be any naturally occurring amino acid
  misc_feature (634)..(635): Xaa can be any naturally occurring amino acid
  misc_feature (639)..(640): Xaa can be any naturally occurring amino acid
  misc_feature (642)..(661): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXRRXRRPFXVXEVEXLVXAVEXLGTGRWRDVKXXXFXXXXHRTYVDLKXXXWKTLVHTAXIXPQQRRGXPVPQXLLXRVLXAXXYWSXXQXXXXXXXXXXXXXXXXXXXX

SEQ ID NO: 6029 - protein, 439 aa, artificial Sequence
  Consensus Sequence
  misc_feature (1)..(12): Xaa can be any naturally occurring amino acid
  misc_feature (15)..(17): Xaa can be any naturally occurring amino acid
  misc_feature (20)..(20): Xaa can be any naturally occurring amino acid
  misc_feature (22)..(22): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(35): Xaa can be any naturally occurring amino acid
  misc_feature (37)..(38): Xaa can be any naturally occurring amino acid
  misc_feature (44)..(44): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(56): Xaa can be any naturally occurring amino acid
  misc_feature (61)..(61): Xaa can be any naturally occurring amino acid
  misc_feature (64)..(64): Xaa can be any naturally occurring amino acid
  misc_feature (70)..(70): Xaa can be any naturally occurring amino acid
  misc_feature (77)..(78): Xaa can be any naturally occurring amino acid
  misc_feature (80)..(80): Xaa can be any naturally occurring amino acid
  misc_feature (82)..(83): Xaa can be any naturally occurring amino acid
  misc_feature (88)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (98)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (109)..(109): Xaa can be any naturally occurring amino acid
  misc_feature (111)..(113): Xaa can be any naturally occurring amino acid
  misc_feature (119)..(120): Xaa can be any naturally occurring amino acid
  misc_feature (123)..(123): Xaa can be any naturally occurring amino acid
  misc_feature (125)..(126): Xaa can be any naturally occurring amino acid
  misc_feature (131)..(137): Xaa can be any naturally occurring amino acid
  misc_feature (139)..(139): Xaa can be any naturally occurring amino acid
  misc_feature (142)..(145): Xaa can be any naturally occurring amino acid
  misc_feature (149)..(149): Xaa can be any naturally occurring amino acid
  misc_feature (156)..(156): Xaa can be any naturally occurring amino acid
  misc_feature (159)..(160): Xaa can be any naturally occurring amino acid
  misc_feature (164)..(164): Xaa can be any naturally occurring amino acid
  misc_feature (166)..(167): Xaa can be any naturally occurring amino acid
  misc_feature (169)..(171): Xaa can be any naturally occurring amino acid
  misc_feature (173)..(173): Xaa can be any naturally occurring amino acid
  misc_feature (175)..(198): Xaa can be any naturally occurring amino acid
  misc_feature (200)..(439): Xaa can be any naturally occurring amino acid
XXXXXXXXXXXXPTXXXLPXGXRFRXTXXEXXXXXLXXKKALGXPMKAXTXPXECXDIFSXHPXDLPGYXSEEHWYXXCXKXXNQVTXXXSXNLWXPXGEXTXVLDPKXNXXXLVGIKXXFTXIXXEEEEXXXXXXXDXEEXXXXNWFXDEISLPXTVXXTDWXLXXIXXXKXKXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 6030 - protein, 226 aa, artificial Sequence
  Consensus Sequence
  misc_feature (2)..(23): Xaa can be any naturally occurring amino acid
  misc_feature (25)..(45): Xaa can be any naturally occurring amino acid
  misc_feature (48)..(54): Xaa can be any naturally occurring amino acid
  misc_feature (57)..(57): Xaa can be any naturally occurring amino acid
  misc_feature (60)..(61): Xaa can be any naturally occurring amino acid
  misc_feature (63)..(65): Xaa can be any naturally occurring amino acid
  misc_feature (68)..(86): Xaa can be any naturally occurring amino acid
  misc_feature (99)..(99): Xaa can be any naturally occurring amino acid
  misc_feature (105)..(105): Xaa can be any naturally occurring amino acid
  misc_feature (112)..(156): Xaa can be any naturally occurring amino acid
  misc_feature (158)..(160): Xaa can be any naturally occurring amino acid
  misc_feature (163)..(165): Xaa can be any naturally occurring amino acid
  misc_feature (174)..(174): Xaa can be any naturally occurring amino acid
  misc_feature (176)..(178): Xaa can be any naturally occurring amino acid
  misc_feature (180)..(181): Xaa can be any naturally occurring amino acid
  misc_feature (183)..(183): Xaa can be any naturally occurring amino acid
  misc_feature (185)..(186): Xaa can be any naturally occurring amino acid
  misc_feature (190)..(190): Xaa can be any naturally occurring amino acid
  misc_feature (200)..(201): Xaa can be any naturally occurring amino acid
  misc_feature (203)..(205): Xaa can be any naturally occurring amino acid
  misc_feature (207)..(226): Xaa can be any naturally occurring amino acid
MXXXXXXXXXXXXXXXXXXXXXXKXXXXXXXXXXXXXXXXXXXXXWRXXXXXXXYSXKLXXAXXXVRXXXXXXXXXXXXXXXXXXXAVREAADRALAVXARGRTXWSRAILXXXXXXXXXXXXXXXXXXXXXXXXXXXXXXXXXXXXXXXXXXXXXPXXXRKXXXLGRLVPGCXKXXXPXXLXEXXDYIXALEMQVRAMXXLXXXLXXXXXXXXXXXXXXXXXXXX

SEQ ID NO: 6031 - protein, 411 aa, artificial Sequence
  Consensus Sequence
  misc_feature (1)..(3): Xaa can be any naturally occurring amino acid
  misc_feature (5)..(5): Xaa can be any naturally occurring amino acid
  misc_feature (7)..(11): Xaa can be any naturally occurring amino acid
  misc_feature (13)..(23): Xaa can be any naturally occurring amino acid
  misc_feature (25)..(31): Xaa can be any naturally occurring amino acid
  misc_feature (33)..(33): Xaa can be any naturally occurring amino acid
  misc_feature (41)..(41): Xaa can be any naturally occurring amino acid
  misc_feature (44)..(45): Xaa can be any naturally occurring amino acid
  misc_feature (48)..(49): Xaa can be any naturally occurring amino acid
  misc_feature (51)..(52): Xaa can be any naturally occurring amino acid
  misc_feature (54)..(411): Xaa can be any naturally occurring amino acid
XXXPXKXXXXXRXXXXXXXXXXXPXXXXXXXVXTGFPTSLXDLXXKNXXRXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 6032 - protein, 341 aa, artificial Sequence
  Consensus Sequence
  misc_feature (1)..(30): Xaa can be any naturally occurring amino acid
  misc_feature (33)..(34): Xaa can be any naturally occurring amino acid
  misc_feature (46)..(46): Xaa can be any naturally occurring amino acid
  misc_feature (48)..(48): Xaa can be any naturally occurring amino acid
  misc_feature (51)..(52): Xaa can be any naturally occurring amino acid
  misc_feature (57)..(57): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(72): Xaa can be any naturally occurring amino acid
  misc_feature (74)..(75): Xaa can be any naturally occurring amino acid
  misc_feature (77)..(77): Xaa can be any naturally occurring amino acid
  misc_feature (79)..(79): Xaa can be any naturally occurring amino acid
  misc_feature (97)..(97): Xaa can be any naturally occurring amino acid
  misc_feature (103)..(104): Xaa can be any naturally occurring amino acid
  misc_feature (129)..(129): Xaa can be any naturally occurring amino acid
  misc_feature (131)..(131): Xaa can be any naturally occurring amino acid
  misc_feature (134)..(135): Xaa can be any naturally occurring amino acid
  misc_feature (140)..(140): Xaa can be any naturally occurring amino acid
  misc_feature (151)..(151): Xaa can be any naturally occurring amino acid
  misc_feature (164)..(165): Xaa can be any naturally occurring amino acid
  misc_feature (175)..(175): Xaa can be any naturally occurring amino acid
  misc_feature (183)..(183): Xaa can be any naturally occurring amino acid
  misc_feature (185)..(189): Xaa can be any naturally occurring amino acid
  misc_feature (193)..(193): Xaa can be any naturally occurring amino acid
  misc_feature (196)..(201): Xaa can be any naturally occurring amino acid
  misc_feature (203)..(203): Xaa can be any naturally occurring amino acid
  misc_feature (206)..(206): Xaa can be any naturally occurring amino acid
  misc_feature (209)..(211): Xaa can be any naturally occurring amino acid
  misc_feature (214)..(214): Xaa can be any naturally occurring amino acid
  misc_feature (218)..(219): Xaa can be any naturally occurring amino acid
  misc_feature (234)..(234): Xaa can be any naturally occurring amino acid
  misc_feature (238)..(240): Xaa can be any naturally occurring amino acid
  misc_feature (242)..(243): Xaa can be any naturally occurring amino acid
  misc_feature (245)..(247): Xaa can be any naturally occurring amino acid
  misc_feature (249)..(249): Xaa can be any naturally occurring amino acid
  misc_feature (255)..(255): Xaa can be any naturally occurring amino acid
  misc_feature (259)..(260): Xaa can be any naturally occurring amino acid
  misc_feature (262)..(262): Xaa can be any naturally occurring amino acid
  misc_feature (264)..(265): Xaa can be any naturally occurring amino acid
  misc_feature (271)..(271): Xaa can be any naturally occurring amino acid
  misc_feature (273)..(275): Xaa can be any naturally occurring amino acid
  misc_feature (278)..(278): Xaa can be any naturally occurring amino acid
  misc_feature (280)..(281): Xaa can be any naturally occurring amino acid
  misc_feature (283)..(285): Xaa can be any naturally occurring amino acid
  misc_feature (287)..(287): Xaa can be any naturally occurring amino acid
  misc_feature (289)..(307): Xaa can be any naturally occurring amino acid
  misc_feature (309)..(315): Xaa can be any naturally occurring amino acid
  misc_feature (317)..(317): Xaa can be any naturally occurring amino acid
  misc_feature (319)..(326): Xaa can be any naturally occurring amino acid
  misc_feature (328)..(341): Xaa can be any naturally occurring amino acid
XXXXXXXXXXXXXXXXXXXXXXXXXXXXXXLLXXEDEVIISRYLKXMXVNXXSWPDXFIEDAXVFXKXPXXXFXXEXPXFVIVKPRTEACGKTDGCXSGCWRXXGRDKLIKSEETGKILGFKKILKFCXKXKPXXYKRSXVMEEYRLTNNXNWKQDHVICKIRXXFEAEISFLLXKHFYTTSXSXXXXXLLPXYGXXXXXXQXEDXFYXXXIMXSEGXXWPSYVTNNVYCLHPXELVXXXDXXFXXXGXCIFANXTCGXXDXCXXGYWKIXHXXXLIXSXXGXXXGXKXXXXXXXXXXXXXXXXXXXVXXXXXXXEXRXXXXXXXXKXXXXXXXXXXXXXX

SEQ ID NO: 6033 - protein, 204 aa, artificial Sequence
  Consensus Sequence
  misc_feature (1)..(25): Xaa can be any naturally occurring amino acid
  misc_feature (27)..(32): Xaa can be any naturally occurring amino acid
  misc_feature (42)..(42): Xaa can be any naturally occurring amino acid
  misc_feature (44)..(44): Xaa can be any naturally occurring amino acid
  misc_feature (54)..(56): Xaa can be any naturally occurring amino acid
  misc_feature (62)..(62): Xaa can be any naturally occurring amino acid
  misc_feature (65)..(68): Xaa can be any naturally occurring amino acid
  misc_feature (74)..(75): Xaa can be any naturally occurring amino acid
  misc_feature (78)..(79): Xaa can be any naturally occurring amino acid
  misc_feature (82)..(82): Xaa can be any naturally occurring amino acid
  misc_feature (84)..(86): Xaa can be any naturally occurring amino acid
  misc_feature (89)..(89): Xaa can be any naturally occurring amino acid
  misc_feature (91)..(92): Xaa can be any naturally occurring amino acid
  misc_feature (95)..(96): Xaa can be any naturally occurring amino acid
  misc_feature (98)..(100): Xaa can be any naturally occurring amino acid
  misc_feature (102)..(113): Xaa can be any naturally occurring amino acid
  misc_feature (115)..(119): Xaa can be any naturally occurring amino acid
  misc_feature (121)..(123): Xaa can be any naturally occurring amino acid
  misc_feature (125)..(126): Xaa can be any naturally occurring amino acid
  misc_feature (128)..(128): Xaa can be any naturally occurring amino acid
  misc_feature (131)..(132): Xaa can be any naturally occurring amino acid
  misc_feature (134)..(143): Xaa can be any naturally occurring amino acid
  misc_feature (145)..(145): Xaa can be any naturally occurring amino acid
  misc_feature (148)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (156)..(161): Xaa can be any naturally occurring amino acid
  misc_feature (163)..(164): Xaa can be any naturally occurring amino acid
  misc_feature (166)..(168): Xaa can be any naturally occurring amino acid
  misc_feature (170)..(171): Xaa can be any naturally occurring amino acid
  misc_feature (173)..(204): Xaa can be any naturally occurring amino acid
XXXXXXXXXXXXXXXXXXXXXXXXXKXXXXXXERQRRQEMAXLXASLRSLLPLXXXKGKRSXSDXXXXAVNYIXXLQXXIKXLXXXRDXLXXLSXXSXXXSXXXXXXXXXXXXSXXXXXVXXXCXXGXEIXXSXXXXXXXXXXSXVLXVLXEXGLXXXXXXSXXVXXXLXXTXXXXXXXXXXXXXXXXXXXXXXXXXXXXXXXX

SEQ ID NO: 6034 - protein, 374 aa, artificial Sequence
  Consensus Sequence
  misc_feature (1)..(139): Xaa can be any naturally occurring amino acid
  misc_feature (141)..(146): Xaa can be any naturally occurring amino acid
  misc_feature (148)..(157): Xaa can be any naturally occurring amino acid
  misc_feature (159)..(160): Xaa can be any naturally occurring amino acid
  misc_feature (162)..(176): Xaa can be any naturally occurring amino acid
  misc_feature (178)..(182): Xaa can be any naturally occurring amino acid
  misc_feature (184)..(190): Xaa can be any naturally occurring amino acid
  misc_feature (192)..(194): Xaa can be any naturally occurring amino acid
  misc_feature (196)..(197): Xaa can be any naturally occurring amino acid
  misc_feature (199)..(206): Xaa can be any naturally occurring amino acid
  misc_feature (208)..(211): Xaa can be any naturally occurring amino acid
  misc_feature (214)..(216): Xaa can be any naturally occurring amino acid
  misc_feature (218)..(219): Xaa can be any naturally occurring amino acid
  misc_feature (221)..(221): Xaa can be any naturally occurring amino acid
  misc_feature (224)..(238): Xaa can be any naturally occurring amino acid
  misc_feature (240)..(260): Xaa can be any naturally occurring amino acid
  misc_feature (262)..(267): Xaa can be any naturally occurring amino acid
  misc_feature (269)..(283): Xaa can be any naturally occurring amino acid
  misc_feature (285)..(324): Xaa can be any naturally occurring amino acid
  misc_feature (326)..(326): Xaa can be any naturally occurring amino acid
  misc_feature (329)..(330): Xaa can be any naturally occurring amino acid
  misc_feature (332)..(338): Xaa can be any naturally occurring amino acid
  misc_feature (340)..(342): Xaa can be any naturally occurring amino acid
  misc_feature (344)..(347): Xaa can be any naturally occurring amino acid
  misc_feature (349)..(349): Xaa can be any naturally occurring amino acid
  misc_feature (351)..(374): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXWXXXXXXXXXXLXXAXXXXXXXXXXXXXXXVXXXXXHXXXXXXXKXXXAXXDXXXXXXXXWXXXXERXXXWXXGXRPXXXXXXXXXXXXXXXEXXXXXXXXXXXXXXXXXXXXXQXXXXXXLXXXXXXXXXXXXXXXAXXXXXXXXXXXXXXXXXXXXXXXXXXXXXXXXXXXXXXXXDXLRXXTXXXXXXXLXXXQXXXXLXAXXXXXXXXXXXXXXXXXXXXXXXX
